United States Patent 11,739,335 (NUCLEIC ACIDS ENCODING CRISPR-ASSOCIATED PROTEINS AND USES THEREOF) - sequence listing, part 9

SEQ ID NO: 6641 - RNA, 4122 nt, Artificial Sequence
  Cas9 variant
auggagaagacauacagcauuggucuugacauaggaaccaacagcgucggcuggagcgucauuacggacgacuacaaaguacccgcaaagaaaaugaagguacuugguaacaccgacaagaaauacauaaagaaaaacuugcuuggagcccuccuuuucgacagcggcgaaaccgcagaggucacucgacugaaaaggaccgcccgacgacgauacacgcgccgcaaaaaccgacuccgguaccugcaggaaauauucgcaaaagaaauggccaaagucgaugagucauucuuccagaggcuggaagaaucauuccuaacagacgacgacaagaccuucgacucacacccuaucuucggaaacaaggcagaggaagaugcuuaccaccaagaguucccaacaauauaucaccuccgaaagcaccuagccgacagcagcgagaaagcagaucuacgauuagucuacuuggcccucgcccacaugaucaaauuccgaggccauuuccucauagaaggcgagcuaaacgcugagaauaccgacauccagaagcuauuuaacgacuuugucgagacauacgacaaaaucgcagaugagucacaccugagcgaagucgaugcuagcaguauccuaacaaauaagauuucgaaaagccgccgccuagaaaaccucauaaaacaauaccccaccgaaaagaaaaacacacucuucggcaaccuggucgcccugguccugggccugcaaccgaacuucaaaaccaacuucaaacucagcgaagacgcgaaacuacaauucaguaaagauaccuaugacgaagaccuagaggagcuguuagggaagauaggcgaugacuacgccgaccuauucacagcggcaaagaaccucuacgacgccauccuccucucgggcauccuaacagucgaugauaauagcaccaaggccccacugucagcauccaugaucaagcgcuacgaggagcaccacgaagaccucgaaaaacuaaagaaauucauaaaagucaacaacuucgacaaauaucaugaaauauucaaggacaagagcaagaacggguacgcgggcuacaucgagaacgggguaaagcaggacaucuucuacaaacacuuaaaauccauaauaucagaaaagaacggcggccaauacuucuuagacaagauagaacgagaggacuuccuccgcaaacaacgaacauucgacaacgggucaauaccacaccagauccaccuccaggaaaugcgcgccauccuccgcagacagggagaauacuaccccuuccucaaagagaaccaauccaagauagagaaaauccuuacauuccgcaucccauacuacgucggcccgcuggcacgcaaaaauucccgauucgccugggcaaaauaccacagcgacgaaccuaucacaccguggaacuucgacgaaguaguagacaaagagaaaagcgccgaaaaguuuaucacccguaugacacuuaacgaccucuaccuccccgaagaaaaggucuugccaaaacacucccacgucuacgaaaccuacgccgucuacaacgagcucaccaagauuaaguacguuaacgagcaagguaaggagagcuuuuucgacucuaacaugaaacaggaaaucuucgaccacgucuucaaagaaaaccgcaaaguaacuaaagagaaacuauuaaauuaccuuaacaaagaauuuccagaguaccggauuaaagaccuaaucggacuagacaaagaaaauaagucauucaacgcaagccugggaacguaucacgaccucaagaaaauauuagacaaauccuuucuugacgacaaagucaacgaggaagucauagaagacauuauuaaaacacucacccuguucgaagacaaggacaugauucacgaacgauuacagaaauacucggacauauuuacagcgaaccaacuaaagaaacucgagcgccgacauuauacaggauggggucgccucagcuacaaacuaaucaauggcauuagaaacaaagagaauaacaaaacgauccuggauuacuuaaucgacgauggaucugccaaccgcaacuucaugcaacucaucaaugaugacacgcugcccuucaagcaaaucauccaaaagucucagguggucggagacguagacgacauagaagccgugguacacgaucuccccggauccccagcuaucaagaaagggauccuccaauccgucaaaauaguagacgaacuggucaaagucaugggcggaaacccggauaauauaguuauagaaauggcccgugagaaccagaccacuaaccgcggacgaucccaaucacaacagcgccugaaaaagcugcaauccagccucaaggaacuugggagcaacaucaucaacgaagaaaagcccuccuacaucgaggauaagguagagaacucacaucuacaaaacgaccaacuauuccuauacuauauccaaaacggcaaggacauguacacgggugacgaacuugacauagaucaccucagcgacuacgacaucgaccauaucaucccacaggcguucauaaaagacgacagcauugacaaccgcguauuaacauccuccgccaagaaccgaggaaagucggacgaugugcccucccuggacaucguacgagcccgaaaagccgaaugggucagacuauacaaauccgggcugaucuccaagcgcaaauucgauaaccucaccaaggcagagcgcgguggccuuacggaggcagauaaagcaggcuucaucaaacgacaacuuguugaaaccaggcagauaacaaaacacguagcccagauucucgaugcucgcuucaacacagaacacgacgaaaacgacaaagugauucgagacgugaaagucaucacacuaaagagcaaccucguaucacaguuuagaaaagacuucgaguucuacaaaguacgcgaaaucaacgacuaccaucaugcccacgacgcauaccugaacgccgucgucggaaccgcauugcuaaagaaauacccaaaacucgcccccgaguucguguacggagaauacaaaaaguaugacguaaggaaacucauagccaaauccagcgacgaccacagcgaaauggggaaggccacagcaaaauacuuuuucuauuccaaccuuaugaacuucuucaagacaaaaguaaaauacgccgauggcuccguauaugaacgacccauaaucgaaacgaacgccgacggcgaggucguauggaacaagcagaaagacuucgaaauaauccggaaaguccucagcuacccccaagugaauauagugaagaaagucgaggaacagacaguaggacaaaacggcggccucuucgacaacaacauccucgcaaaaccagaaaaagacgacaaaaagaaacucuuccccaucaagaagucucucucuaccacaagcuacggcggcuacgcgcgggcuacaaucgcauacagcauacuuaucguuagcgaguucggcaaaaacaaggaacucaaauugcucggccuaccacuccucgauaagguuaaguaugaaaagaauccaauugccuaccuaaacagcauaggaauaaucaacgugaaaucaauauucaaacuaccaaaguacugccuauucgaauuucaagagaaaaacacaaacuaccgccgguacaugguaucuaaccaagagcuaaaacgggcaaaccaacuauuccugaccugcaaggagacggaacucguauacaaguacauaaaaagcgauaaugacaacacccaccuggugggaaacgagaaaacaauccugagcauauggaacaaacuggucauuuucauggaacgaacaaagcuaaucgacaagaaacucuucgcgagccucaaacagcucaaagacgaagugaaccucaucaacauccuggauaucgccuccaagagcaucgacuucaccaaaauaucagcaggacaaaagaaaauaguccugaacgauagccucucccugccuaucaaacgauggcaauuuaaauccgacgagaaaaugcucaaacaacuaaacgaugccacccuaauccaccaguccauaacggggcucuacgaaacccgcaucgaccuaucaaagcucggcgaggaauga

SEQ ID NO: 6642 - RNA, 4122 nt, Artificial Sequence
  Cas9 variant
augaaucucagacgcgcgcgcgacuacucaaucggacuagaccuaggcacaggcuccgucgggugggcggucacggacgccgaaggcaaccucuauuccuucaaaggacguccagccaugggcucgcggacauuccccaacgcagagccggcauccguagcaagaaucccgcgaggccaacgcagaagguacgagagaagacgccaacgaaucaaacuccuacaacaguucuucaugagcgacauggaacgcgucgacccggacuucuucaccagacuaaaccagucgacccuacuagcggaagacaaagacgagcgcauugccucaugcgcguggccaaucuucaacagcucagacuuuacagaaaaagauuauuacaagaaauuuccaacgaucuaucaccucagagccuuccugugcgaaagcgacgaaaaaggggaccuucgcuuagucuacuuggcccuacacaacauaguaaaacaucggggcaacuuucuauaccaagacaaucccgcacucagcgcauccgacgcauccgucgacgaagccguccggcaacucguagacgcauuagcagaauggugucaaaacaaagagaucgaacugagcugcgacgcuggaaggaucaucgaaguauucggagacgccuccuuacgccgaacagauaaacgagaccaacuaaaaggccuccucgggcugccagcggaccucgcaaaaacaauggggaaagaacucgccucugcagugcuaggcuacgcggcuaacuuuaguaaaauauuccuaauuuccgaugcggaacacaaauucucgcuaggcaacgacgagaaggucgaagaguucgaaaccauaugcccuaacgagugcacuagcuuguucagcgcccucaggacagcguacagcgcauaccuacuauccggcauccuccgagacgcaaacggaaaaacacucucauucugcaagaagaaagaauacgaccgcuaccacgacgaccuagcccuccucaaagcgcucgucagagaauaugcacccgaaucguaccaauccuucuucggcggcgaacggcucguggucaacggcagaaugaccaaaagauacgacccuacaaaggcgaaaggcuacaccaaauacgacuugguccacuccgccgguucguacgacgaacuagcgaaagacguaaagaagcuccucgguagccuggccgccgacgacagcagguaccaaaggaugaugcaagccuuugacgaggagcgcuuccuccgucgacucaaaacguccgacaacggcuccaucccauaccaguugcaccucgaggaacuacgagccauuauagcgaggcaaggggaguucuauccuuuccucaaagaagaaagcaagaaaaucgaaucauuaguuagcuucagaaucccauacuacguaggaccccuaacgaccaaaaacgccgccguagauguccacggcaacaaacgcuucgccugguccgaacgcaaaccggguauggagagcgcaaaagugcggccauggaacugggacgacgucaucgaccgggggaaaagcgcggaaaacuuuauaguacgaaugacaggcacaugcacuuaccugcaaaacgaaaaagugcugccuaaauguagccugcuguacgaagaguucugcguccuaaacgaacugaacggcgcucacugguccgcagacggagaccacgaaugcccauucgacacgucagacagacgaggaauaguccaggaccucuucugcggcaaacgcagaguaucuuacaaacaaguggaagauuggcugcgccaacauggcagucguagagcccgagucagcggcggacaaggcgcgagcggcuucgaaucaaaaauguccucauacaucuucuucuccaaagacguacuacauguagacaggauagaccccgccgacuuuccaaugaucgaagagauaauucucuggaacacccuguucgaagacagggacauucuaaaagaacgcauugaggaagccuacggcgaccgccucaacgccgaacaaauaaagacgaucugcaaaaagcgcuucacuggguggggccgucuaucgaggcggcuacuaaccggcauaaaagcucagaccgaucaaggggaucucuccauaauggacauccugagagaaggcgaccccaacaacgaucacagaggcaaagcgauggucuucaugggaauacuucacuccgaggaccucggauuccagaagaaaaucgaccaaauaaaccaagagaaaguaagugcaggcaaaguaucccuagaagaucucccaggauccccagcacuaagacgcuccaucaaccaagccaugagaguugucgacgagauagucucgaucgccaaaugcccucccucacacaucuaccucgaaguaacccgagacgaagacggagcccgcaaaggacgacguuccacgagacgcuacgacgccaucaaagcagcccuagaaaaauucaaagaggaauccccuacgugguucgaucaggacguguuuggagaguuccggcgcagcagagcggaggaccuagaugaacgcuuaagccuauacuucaugcaaggaggcaaaagucuauacuccgcaacaccccucaaacucgaacuccuacauaccaaccaauaccaagucgaucauauuauaccacaaagcuacaucaaagacgauuccuucgaaaacaaagcccuuguccuagcgggggaaaaccagcgcaaguccgacgcccuccucaucgauucuagcauacgaaccgccauggcccccuacuggcgggcccuacaccaagccggccuuaugggcgacaagaaauucaacucccuaauguguuccucaauaagugacaaacgaguccggggauucaucgcaagacagcuaguagaaacaagccaaaucguaaagcuagcgggcaugaugcuccaaucgaacuacccugaggccgacguccaacccgucaaagcgucgcucggccacgaccuacggguacaagcgggcuucauaaagugccgagagguaaacgauuuccaccaugcccacgacgcccuaauagcgugcgaagucggacguuacauaaaucaaugccaccccggcauauaugacaacccgauuggauacgcgcgagccguaagggagcuaguaagaaaacaaaacgaagagaugcgcaaauacggccgccuucccggcucggccggauucauaguagguggcuucaugcggacacacguagaugucgauacaggagagguaguaugggacgcugaagaggaacuaucccgcauccgagcauaccuagacuauagcaacguguucgugacccgaaugagcgaagagaccagcggagcacuguggaacgcgacaaucuacagcccccauuacggaaaaaccgccccaacccugcacaucaagcaaggacucgacguacaacgauacggcggauacuccagcgccaccuucgcauacuucacccuauacguugcagaaaaagggaagaaacgaaaagccgagcuccugggcauccccauaagcgucgcaagaaaaaucgaaggcgaacccagcaaacucgacgcauucguugcacaggacgccgaagccaagaaacuaaaacacccccucaucauacgggcccguauauuaaaauacgcccgauucgagauggagggcaaccaauucuacuuugcggcgcaagacgcuguauacuccgcccgccagcucguacugaagggagaccuauacuccguggccgccaaggccugcgacaaacaccucaaugauuccugcaucucaaacgaagaccuaauacggcucuacgacgagcucguacacaaaggcgaccuucuaugcaacaaauucggcaacgucaccgacguacuucgagccggacgagaacgauacgccggacugagcaucagcgaaaagcggcaacuugucugcaacguucuggccuauuaccguagcgccaccgcgcgcguggacauuucucuggucggcggccccaaacacgccggaaaccucgggauugccuucguacucaacaaccccgaagcaaucgucuucgucgaccaaucagucaccgggauguuugaaaagcgcacaagaguagaacuguga

SEQ ID NO: 6643 - RNA, 4122 nt, Artificial Sequence
  Cas9 variant
augaagaaaauauuaggccucgaucucggcacuaacucaaucggcugggcacuggugaacgaagcagacaacgaacgagaaaagagcucgaucaucaaaaucggggugcgagucaacccacuuaccguagacgagcaacaaaacuuugaaaaagggaagucaauaaccaccaacgcggaucgaacccuuaaaagaagcaugcgccgcaaccuccagagguucaaacuacgaaaagagaaccucaucgagauccucaagaaacaaaaguucaucaacgacgagacaauccuaucggagaacgguaacaagucaaccuucgaaacuuacaaccuacgcgcaaaauccgcaacugaagaaauaacccucgaacaguuugcacgcguccugcuaaugaucaacaagaaacgcggcuauaaaagcucucggaaagccaaaucacaggacgaagggcaacucauagacgggauggaaauugccaaaaagcucuacaacgauaaucucacccccgggcaauucguauuccaaauacuaaaggagggcaagaaauacauccccgacuucuaucgcagugaccuacaagcagaguucgacaaaaucuggucauuccaaaaacaauucaacccugacauccugacggaggaguucaacaaacagaucaucggcaaagggaaggugaacacaaccaaaaucuuccuugcaaaauacggaauauacacaaucgacaacaaaggugccgacaagaaaucucaagcauacaauuggcgaguagaagccuugaccaaccaguuaacgaaagaagaacucgccuucguuauaagcgaccucaacgguaucaucucaaacagcucaggauaccucggauccauuuccgaccguagcaaagaauuguacuucaacaaacagaccgugggccaauaccuaaucgcgcaacuaaaagaaaacccccacacccagcucaaaaaccaaguuuucuaccgacaagacuaccuagacgaguucaacaccauuugggagacacaagcaaaauuucacaaggaacugaccaacgaacugaaagaagagauucgcgacauaauuaucuuuuaccagcgaaaacuaaaaagccaaaaaggccucaucagcuuuugcgaauuugaauccaaacagauagagauaaacauagacgggaaaaagaaacucaaaaccguaggcagcaaggucugcccgaaguccagcccccuauuccaaguguucaagaucuggcagauccuaaacaacauccaaguaauagaaaaauccacagggaaauccaaguuccuggaacaggaugagaaggaaauucucuucaaagaacucaacuucaaagacaaaauuuccaagaccgacgcccugaaaauccuauauaagaacuacaaggaacucgacuucaacuucaaagaaaacaucgagggaaaccgaacccaggcaacauuucucaaggcguuccaaagcaucauagaacucucuggccacgaaguaucagacuuuucaaaaaucaaaaccgaugagauacuggagauugucacccccauauucgaaggguucgguuucaacacaaaccugcuacaauucaacagcaaccucaagggcaaggacuucgagaaacaggcggucuaucaauuauggcaccuccucuacucuuucgagggagacaacucaaauacaggcaacgaaaaacucauccagaagauaucggagcuguacggcuucgaaagagaguacgcaaucaucaucgcuaacaucagcuuccaacccgacuacggcagccuguccaccaaagcaauccgaaaaauccugccgcaucugaaggaaggaaucgaguucucgcucgcgugcgaauacgcgggguaccgccacuccaagaacagccucaccaaagaagaaaagaacaagaaaauccucaaagacaagauagacauauugcccaaaaacagccuccgcaaccccgucguagagaaaauccugaaccaaaugauaaacgucguaaacgcaaccauugaaacguauggcaaacccgacgaaauucgcaucgaacucgcgcgggagcucaaaaagagcgcaaaagaacgagaggaccuaaccaacgcaaucaacaaauccacgcucgaccacgaaaaauacaaagcacuacugcagaaagaauuugggcuguccaacgucucccgcaacgacaucauacguuacaaacuuuaccuagagcucgaacacaauggauuucacacccucuacucaaacaccuacaucgagcccaacaaacucuucagcaaagaguucgacauugaacacauuaucccccaaaguagacucuucgacgacagcuucaguaacaaaacgauugaaucaaggucggcaaacaucgaaaaggggaaugaaacagccuucgacuacguaucaaacaaaaacggcgaaguuggccucaaagauuauuuaaagaacauagaagaucuauucaacaauggcaaaauaagcaaaacaaaauacaacaaacuaaaaaugaagggagaugaaauacccagcgacuucaucgcgcgagaccuccgggacacgcaguacauuagcaagaaggccaaaagcauacuagaggaccuggucaaggacgucguaucuaccggaggcucuaucaccgaccggcucagagaggacuggcaauuaaucgauauaaugaaagagcugaacugggacaaauacgacaaacucggccugacugaagucauugagaacaacgacggccauaaaaucaacagaauuaaagacuggacaaagcgcaaugaucaccgccaucacgccauggaugcccuaacuaucgccuucacaaagcggagcuacauccaauaccugaacaaccucaacgcacgcuccgacaaauccggaucaauuuacggaaucgagcaaaaggagcucuaccgcgacaagaacaauaagcugagauucaaacccccuaucccguuggacgacuuccgugcagaagccaagaaacagcucgaaaacacguuggucuccaucaaagcgaaaaacaaagucgcaaccaucaacauaaacaacacgaagaaacagggcggagaaaacaaaaagaaacaacuaaccccgcguggacaacuacaucuggagacaauauacggaucuauccaacaguacgucaccaaagaggaaaaaguaggcgcaaacuucaauaaagaacugauugaaaagguagccaauaagaaaugccgcgaagcacugcuaaaacggcugaucgaguucgacaacgacccaaagaaagcguucacgcgcaaaaacucccucaauaaaaauccacucuacaucgacacaaucaaaacuuacaaaguaccggaaaaagucaaaacagucacaacggaaaccaucuacaccauccgaaaagacauaaacccagaccucaaaaucgacaaaguaguagacaagaaaauuaaaaacauccucgaacuccgacuuaaagaguucaacggcgaugcuaaaaaggcauucuccaaccuggaugaaaagccgaucuggcugaacaaggaaaaagggaucaguaucaaacggguaacuaucaccgguauuagcaaugcaaucgcgcuccacgacaagaaagacaaagaaggcaauuucauccucgacaaccaagguaaaaagcaagccguugacuucgucaacaccggaaacaaccaccacgucgccauauacaaagacgaaaaaggcaaccuacaagagaauguaauuacguucuacgaagcaguggaacgcguaaaccaaggcauuccgauaauagacaaaaccuacaaacaaaacgaaggcuggcaauuccuauucucaaugaaacaaaacgaauacuucgucuucccaaacgaaaagacaggcuucaacuccaacgaaauagaccuacugaacccggagaacuaccaccucaucucacccaaccuauuccgaguacagaaaaucgccaccaaggacuacuucuuccgccaccaccuagaaacaaacguugaaaacauuaccaccacaaaggaucuaaccuggaaacgacuugggaucaaugggaucaucaacaucuuaaaaguacgcaucaaccacaucggacaaauaguguccgugggugaauacuga

SEQ ID NO: 6644 - RNA, 4122 nt, Artificial Sequence
  Cas9 variant
augacgaagaaaaauuacuccaucggacuugacaucggaacaaauagcgucggcugggcggucaucacggacgacuacaaggucccggccaagaaaaugaaaguccugggcaacaccgacaaaaaguauaucaagaaaaaucugcuaggggcacuauuauucgacuccggcgaaaccgcagaagcaacccgacugaaaagaaccgcacgacgccgcuacacuagaaggaaaaaccgccucagguaccuacaagagauauucgccgaagaaaugacgaaagucgacgaaucuuucuuccaacgcuuagacgagagcuuccuaagaugggacgacgacaacaaaaagcucggccgcuacccgauauuuggcaacaaggccgacgugguaaaauaccaucaagaauuuccuacaaucuaccaccugaggaaacaccuagccgauucauccgaaaaggccgaccuccgccucgucuaccucgcucuagcacacaugaucaaauuccgcggccacuuccuaauagaaggagaacucaacgccgagaacaccgacguucaaaagauauucgcggacuucgugggcguuuacgaccgaacauucgacgacagccauuuauccgagauaaccguagacgcagcaagcauccuaacagaaaagauuuccaaaagccggcgacuggaaaaccucaucaaauacuacccuacggaaaagaaaaacacauuauucggcaaccugaucgcucuggcccuaggacugcaacccaacuucaaaaugaacuucaaacuaucagaggacgcaaaacuccaauucuccaaggacaguuaugaggaagaccuaggcgagcucuugggcaaaauaggcgacgacuacgcagaccucuucacgagcgcaaagaaccuauaugacgccauccucuuaucgggcauucucaucgucgacgauaacaguaccaaagccccacucucugcuagcaugaucaagagauacgucgaacaucaagaagaccuggaaaaacuaaaagaguucaucaaagcaaacaaaagcgaacucuaccacgacaucuuuaaggacaaaaacaaaaacggcuaugcaggcuacaucgaaaauggaguaaaacaagacgaguucuacaaauaccucaagaauacgcucucaaagauagccggcucagacuacuuccuugacaaaaucgaacgagaagacuuccuacgcaagcagcgaaccuucgacaacggaaguaucccccaccaaauccaucuccaggagaugcacgccauucucagaaggcaaggugauuacuaccccuuccugaaggagaaccaggaccguaucgagaaaauacuuaccuucagaauaccauacuacgugggcccauuagcgcgcaaggacagcagguuuuccugggcggaguaccauagcgacgagaaaauaaccccauggaacuuugacaaagucauagacaaggagaaaagcgcagaaaaauucauaacccggaugacccuaaacgaccucuaccucccugaagaaaagguccuaccgaaacacagccacguuuaugaaaccuacgcagucuacaacgaacucacaaaaaucaaguaugugaacgaacaaggcaaggacuccuuuuucgacucaaacaugaagcaggaaaucuucgaccaugucuucaaagaaaaccgcaaggugacaaaagaaaaacuccugaacuacuuaaacaaagaguuccccgaguaccgaauaaaagaccuaaucgggcuggacaaagagaacaagaguuucaacgccagccuaggaacguaccacgaucucaagaagauccuagacaaagccuuccuagaugacaaaguaaacgaagaagucaucgaagacaucaucaagacccucacacucuucgaggacaaagacaugauccacgagagacuccagaaauauuccgacauauucacggcagaccaacuaaagaaacucgagcgaaggcacuauacaggauggggacggcugucauacaaacugauaaacgggauacggaacaaagaaaacaacaagaccauacuagauuaccuaauagacgacgggagcgcaaaccggaacuuuaugcaacucaucaaugacgacacgcugccguucaagcaaaucauacaaaagagccaggucgucggugacguggacgacaucgaagcagucguccacgaccucccaggcaguccggcgaucaagaagggaauccuacagagugucaaaauaguggacgagcucgugaaagucaugggagacaaccccgacaacaucgucauugagauggcccgagaaaaucaaaccacaaaccgaggacgcucccaaagccagcaacggcugaaaaaguugcaaaacucccugaaagaacugggcucaaauauccucaacgaagaaaaaccaagcuacaucgaagauaaagucgaaaauagucacuugcaaaacgaccagcuauuccuuuacuacauacagaacggcaaagacauguacacaggugacgaacuggacauagaucacuuaucugacuacgauauagaccacaucauaccccaagcguucaucaaggacgacuccauagacaaccgaguccuaaccagcagcgcgaagaaucggggcaaguccgacgacguaccaucacuagacauaguacgagcccgcaaagcugaaugggucagacucuacaaaagcggccucaucagcaagcgcaaguuugacaaccucacgaaggcagaaagaggcggacucaccgaagccgauaaggcgggguucaucaaacgccaacucguagaaacacgccagauuacuaaacacguagcccaaauucuagacgcccgauuuaacacagagagcgacgagaacgacaaaguaauacgcgacgucaagguaauaacccuaaaaaguaaccuuguaucgcaauuccgaaaggacuuugaguucuacaaaguccgagaaaucaaugacuaccaccacgcgcacgacgccuaucuaaacgccguggucgguacugcacuacugaagaaauacccuaaacucgccucagaguucguauacggagaauacaagaaauacgacauaagaaaauucauaacgaacagcuccgacaaagccacagccaaguacuucuucuauagcaaccuaaugaauuucuucaaaagagucauccgcuacagcaacgggaaagucauagucaggcccgucguggaauacagcaaggacacagaagacauugccugggacaagaaauccaacuuccgaacgaucugcaagguccugagcuacccccaagucaacaucgucaagaaagucgaaacccagaccggaggcuucagcaaggaaaguauacuaccaaaaggcgauuccgacaagcucauaccucgcaaaacuaagaaagcauacugggauacaaagaaauacggaggguucgacucaccgaccgucgccuacuccguuuucguaguagcagacgucgaaaaagggaaagcaaagaagcugaaaacggugaaagaacugguugggaucaguaucauggaaaggagcuucuucgaagaaaacccgguggaguuccuagaaaacaaaggguaccacaacauacgagaagacaagcucauaaaacuuccaaaguacucccuauuugaguucgaagggggcaaacgccgacuucucgcaagcgcgagugaacugcaaaagggcaacgaaauggucauacccggacaccugguaaaacuccucuaccacgcccaacggaucaacagcuuuaacucgaccaaauaucucgauuacgucuccgcacacaaaaaggaguucgaaaagguacuuagcugcgucgaggacuucgccaaccuguacgucgacguggaaaagaaccuaagcaaaauccgggccguugcagacucgauggacaacuucucaaucgaagaaauauccaacaguuucauaaaccuccuaacacuuaccgcacucggcgccccagcagacuucaacuuccuuggcgagaaaaucccccgaaaacgauacacgagcacgaaagaaugccugaacgcaacccuaauccaccaaagcauaacgggccuauacgaaacccgaaucgaccucucuaaaaucggagaagaauga

SEQ ID NO: 6645 - RNA, 4122 nt, Artificial Sequence
  Cas9 variant
auggaaaacaaaaacuauagcaucggucuagacaucgggacgaacagcgucgggugggcagucaucacagacgacuacaaaguacccagcaaaaagaugaaaguacugggaaacacggauaaacgcuuuauaaagaaaaaccucauaggcgcacuccuguucgacgaaggaacaaccgcagaggcacgacgacuaaaaagaacggcucggcgcagauacacacgccguaaaaauaggcuaagauaccuccaagagaucuucgcagaagagaugucuaaaguagacucuuccuucuuccaccgccuggacgauucguuccuuauccccgaagacaagaaagggucaaaguaccccaucuucgcaacccucaucgaagaaaaagaguaccacaaacaguuccccacgaucuaccaccuacggaaacagcuugcagacucgaaggagaaaacagaccugcgccucauauaccucgcccuugcgcacaugaucaaauaccgugggcauuuccucuacgaagacacauucgauaucaaaaacaacgacauccagaaaaucuuuaacgaguucaucucaaucuacaacaacacauucgaaggaaacucccuuagcggccaaaacgugcaaguagaagcgaucuucacugauaagauuucuaaaucagccaagagagaacgcguccucaagcuauucccagacgaaaagaguacaggccucuucagcgaguuccucaaacucauagugggcaaccaagcagacuucaaaaagcacuuugaccuggaagaaaaagcaccacuccaauucucacgcgacacauaugacgaagaccuggaaaaucuuuuagggcaaauaggugacgacuucgccgacuuguucguugcagccaagaaacuauacgacgcaauccuccuaaguggcauccucacggucacggaccccagcacuaaagcaccccugagcgccagcaugaucgaacguuacgagaaucaccagaaagaccuagccacccucaaacaauucaucaaaacuaaccuuccagaaaaauaugacgaggucuucuccgaccaauccaaggacggauacgcuggauacauagacggcaagacuacacaggaguccuucuacaaauauaucaaaaaccuacuaaguaaguucgaaggcgcggacuacuuccuagagaagauagaacgcgaagacuuccuacgaaaacagagaacauucgacaacggcagcaucccacaccaaauccaucugcaagagaugaacgccauccuacggcgacagggagaacacuaccccuuccuuaaagaaaacaaggagaaaauagagaaaauacucaccuuccgcauccccuacuaugucggcccgcuggcccgugggaaccgugacuuugcauggcuaacccgcaacucagaccaagccauaagaccauggaacuucgaagaaauaguugacaaagcaaguucagcagaauccuucaucaacaagaugacgaacuacgaucuauaccugcccgaagaaaagguccuaccgaaacacucccuauuauacgagaccuucgccgucuacaaugagcucaccaaagugaaauucauagcagaaggccuccgcgacuaccaauuucuugacucacgccagaagaaagacaucuucuauacgcuuuucaaagccgaagacaaacgcaaaguaacggagaaggacaucauccaauaccuccacacggucgacggcuacgacggcaucgagcucaaaggcauagaaaaacaauuuaacgcgucacucuccaccuaccacgaucuccucaaaaucaucaaagacaaggaauuuauggacgacccaaacaacgaggagauacuagaaaacaucguacacacccuuacgaucuucgaagaucgagagaugaucaagcaaagacuagcccaauacgacagccucuucgacgaaaaagugaucaaagcacuaacgagacgacacuacaccggcuggggcaaacucucguccaagcucaucaacggcauacgcgacaagcaaacagggaagacaauccuggauuaucucauggacgacggcuacaacaaccgcaacuuuaugcagcugaucaaugacgacgaacucuccuuuaaagaaauuauuaaaaaggcccagguagucgggaagacagacgauguaaaacagguagugcaagagcugcccggcagcccggcaaucaagaaaggcauacuacagucgauaaaacucguagacgagcucgucaaagugaugggacaugaacccgaaucaauagugauagagauggcacgagaaaaucaaacuaccgccaggggaaagaaaaacagucaacaacgguacaaacgcaucgaagauucacuaaaaauccuggcaaguggccucaacgccaaaauccuaaaagaacacccgacugacaacauacagcuccagaacgacagacucuuccucuacuaccuccagaacggccgcgacauguacaccggaaaacccuuggacaucaaccagcugagcaguuacgacauugaccauauagugccgcaagccuucaucaaagacgacagccucgacaaccgcguccuuaccucauugaaagauaacagaggcaaaucagacaacguacccucccucgaaguaguagagaaaaugaaaaccuucuggcagcagcuauuagauagcaaacucauaagcuaucgaaaguucaacaaccucacgaaggccgaacgugggggacuggacgaacgagacaaagugggcuucaucaagcgucaacucguggaaacaagacaaauuacuaaacauguagcgcaaauccucgacgcgcgcuacaacacagaaguuaacgaaaaagacaaaaagaaccggacggucaaaauuaucacacuaaaauccaaccucguaucgaacuuccguaaagaguuccgccuauacaaaaucagagagauaaacgacuaccaccacgcccacgacgcauaucugaacgccgucgucgcgaaggccauacuaaagaaauaucccaaacuugaaccggaguucguauacggagauuaccaaaaauaugaucucaaacgguacauaucacgcucgaaagaccccaaagaaauugaaaaggcuaccgaaaaauacuucuucuacuccaaccuacugaacuucuucaaagaggaaguacacuacgccgacgguaccaucgucaaacgagaaaauauagaauacuccaaagacacgggcgaaaucgcauggaacaaagaaaaggacuucgcaacaauaaagaaaguccuuucccucccccaaguaaacaucgucaaaaagagagagguccagacaggaggcuuuaguaaagaguccauccuaccgaagggcaacucagacaaacugauaccuagaaagacaaaagacauccugugggacaccaccaaauacgggggauucgacagcccaguaaucgcuuacucgauccuccugauugcagacauagaaaaaggcaaggccaaacgccucaaaaccguaaagacccucgucggcauaacaaucauggaaaaggcaacuuucgagaaaucacccauagcauuccucgagaauaaaggcuaccacaaugugcgcaaagaaaacauccugugccuaccuaaauacucccuguucgaguugaaaaauggccgacgccgcauguuagcgucagcaaaagaacugcaaaagggaaacgagauuguacuccccguccacuugacaacccuacuauaccacgcuaagaacauccaucgccucgacgaaccggaacaccuugaauacauccaaaaacaccgcaacgaguucaaaggccuccuaaaccuaguaagcgaguucucccaaaaauacguccuagccgacgccaaccuagaaaagaucaaaaaccucuaugcggacaacgaacaagcggacauagaaauccuugccaacagcuucauaaaccuacugacuuucacggcccucggcgcacccgccgcauucaaguucuuuggaaaagacguagacagaaagcgcuacacaaccgugucggaaauccucaacgccacccucauccaccagucaauuacaggacuguacgaaacacguaucgaucucagcaaacuaggggaagacuga

SEQ ID NO: 6646 - RNA, 4125 nt, Artificial Sequence
  Cas9 variant
auggaaaccaaauucacauacuaccuaggacucgacaugggaacugacagucucggcugggcgguaacggauucgagcuaccauauccuccgcgcgaaaggcaaggacuuauggggaguccgauuauuccccucggcagaaacauccguagaacgcaggacguaccgcguaaaccgccgcaggaggcaacgcgaggucgcccggaucggcgcccugaaagagcuauucgcggacgaaaucgaaaaagucgaccccggauucuucguccggcuggacgagaguaaauuccacauggaagaccgcagcgaaaacaacaaacaaaaguacggucuauucgcggacaaacuuuucucagacgcaggcuacuacaaaaaguaccccaccauauuucaucugcgcaaggaacuacucgaauccgaggaaccgcacgacguucgccucguauaccuagcauuacugaacauguuuaaacaccgcgggcacuuucucaacagcucgcugcaaaucgaaggugaaaauucgaacaucgcugagagcuaucagauguucguggacacgcucacggacgaggaucuagacuucccggagcagguaagcggcgagcgacugcaggaaauauucagauccagcgacagccgcaaaaagaaagucgagaaccuccuggccgagaugaaucugagcaagaaacagaaacgggaaauccaguucgucaaccugaucugcggauuaaaagggaagcuaucggagcuauucccggacaaagaauacgacgaagaacaaaagaaaauagcauucagcuuccaggacucggacuacgaagacaaagagaauacgauccaggaacuucuagacgaauccgaaaugaauaugaucuacgcaguaaaagccgugcacgacagcggagugcucucgggcaucaugaacggcgaacgauaccucagcgucgcacgcguggccuccuaugagaaacacaagaaagaccuacagauucugaaagacauacugaagaaauacgacacaaaagaauacuucgaaauguuuaggaaugagucagccaaaucggaaucauacuccgccuacgucggcucagucaaguaccacggcacauuucgcagaggccucagugggggcaaacaagaggaccuauacaagcacaucaaaaagguacucgguaaauucccccaggacgacgaaggagugacuuacauacucgaggagauagagacagaaaguuuccuacccaaacaacugacggcgucaaacggcguuauacccaaccaaguacacgcccgggaaaugcucgccaucuuaaagcacgccgaacucuaccuaccguuccuccaggagaaggacgauacaggauuauccgucuccgaaaagauucuaaaacuauucauguuccaaauaccauacuacguagggccccucggccaagaauauaaagacaagaaaggauacaacgugugggccgagcgcaaagcgagcgggaagauauaccccuggaauuucgaggacaaaauagacguaaagaaaucagcagagaaauucauagggaggaugguacgucgcugcaccuaccucaguggcgaacaggcacugccaaaacagagccuauuguacgaaaaguuccaaguacucaacgagcugaacaaccuccgcauucgcggggagaaaauaccagucagucucaaacaagaaauauaccacgaucuguuuggcgacggaaagaaaguaagcaugaccaggcuuacaaacuaccuccuacagaauggagucauaucaggggaagaaaaagacucauguauauccggcauagacggcggguuucacaacuccuuaucgagcguaggcaaguucaagggaguguucggagacacgguccauacagaugagcaucgcaaaaugaucgaagauauaauauucuggggcacgguauucggagaugggaaaaagcuccuaaaagagaaagucgaagaagucuacgguaaccagcuaacggaggcccagaaaaagcgaauauucggauucaaauucagcagcuggggccgccuauccaaagccuuccucaccauggaaggcgcguccaaggacgacggagaaauaaaaggacucauccaagcuaugugggacacgaacugcaaccuuauggagcuucucucagaccgcuucacauacaaggacaaacuaaacgaaaugguuacaacagccgaaaagccccucugcgaauggaaaaucgaggaccuggacgaaauguaccucucggcccccgucaagagaaugguauggcagacgauccguguaguagacgagguacaacagaucaucggcugcccacccaaacgaauauucgucgaaaugacccgcagcgauggcgagaagggaaagcgcacagucucacgacagaaaaagcuaguagaucuauauaaagcauuaggaaaagagggaaagaccuggagcgaggaacucagcgacacucccgagagccaauuucgaaucaaaaagcuauaucuauacuaccuucaaaugggcaaaugcauguacaccggcgaagccauagaacuggagcaacucaugaaugauaaccuauacgacauagaccacauauacccgcgacacuuuaucaaagacgacaacaucucaaacaaccucguucugguuaagaaagagaaaaacgcacacaaaucggacucauucccaauagaaccggaaauccgcaacaaaaugaugccauucuggaaaagccuacgcaagaaaggguuccuuacggaagaaaaauacaaccgccugaccagaaugucugcguucaccgacgaagaaaaagcagcguucauugggcgccagcugguagagaccagccaagggacgaaagcgaucacccagaucuucgagcaagccuucgccaacagugaaauaguguucagcaaagcauccgucguauccgccuuccgacaaaaauucgacugcuacaaagucaggugcguaaacaauuaucaucacgcccacgacgccuacuugaacaucguagcaggcaacaccuaccgggucaaauucacaucaaacccgcugaauuucauaaaagaagcaaagaaaaaucccaacucacgcgagaaccgauacaacauggacaaaauuuucgaaugggacgucacacgaaacggcgaaacggccugggucgcacagacaaaagaacacccaggaaccauucaauuaguuaagaaauaccuaaacaaaaacagcccccucauaaccaaaauggucuaugagaagcacggcgggauaacgcagaaggccacuaucuggagcgccaagaaagcagaaagcggcaacacagacgccuacauacccgucaaaaugaacgacccccgccucgcugacgucaccaaauacggaggcguaacaacaauagccguagcaggcuacacacuccucgaguacaaggcgggaggcaaaacgguccgcagucuugaagcccuacccaucuaucuaggagggaguaagaaacucacagaggagcaaaugguggaauauuucagcaacguccuacagcaagaaaacaaagagaaaguagucucagacgugauaauaaggaaaaagaugaucccgucuggcucccuaauaaaguacaacggguucuacuauuaccuagcuggaaaaacgggagaccgcaucauacuaauaucagccguccaauuaugccuaccaauggacaccaugcucuacaucaagaaaaucgaaaaagccugcuccaccggcaacuucgaggaaaaagacaaaaacggaaaacaaguccucagcaaacagcagaacgaauuuguguacgaauuaaucauacaaaaauaccaacaguccauauucaaaaagaaagucggagcaaucggcgauacgauaaucgagaaaagagaaaaauucgccgaaauaucacucgaagaacagugcaaaguccucaugcaaauauuucucaacuuccaaagcggaaucggcguagaacugaaaaucauugaaggaggcaagaaaucaggcguaacguaccucaacaagaaaguuaugaauguccaggagcuaaaacucauugaccagagcgucaccggcguauucaguagagagauagaccugcuaaccauauga

SEQ ID NO: 6647 - RNA, 4125 nt, Artificial Sequence
  Cas9 variant
augaagaaacgcuacucauacagcaucggccuggacaucgggaccaacagcgucggaugggcagucauaaacgaggacuacaaaguacccgcuaagaaaaugaccgucuucggcaacaccgacagaaaaacaaucaaaaagaaccuacucggcacaguccuuuucgacucgggugaaacggcgcaggcacggcgacucaaacgaacgaaccggcgccgauacacgcgccgccgcuaccgacuaugccagcuacaaaacauauucgcaacugagauggucaaagucgacgauaccuucuuccaacggcuaagugaaucauucuuuuacuaccaagacaaggcauuugacaaacaccccauauucggaaauucaaaggaggaacgcgcauaccacaagacauauccuaccauauaccaucuccggaaagacuuagcagaccgcgaccaaaaagccgaccuacgccucauauaucuagcgcuaucacacaucaucaaauuccggggacacuuucuaaucgagggcaagcucaauucagaaaacacagacguacagaaacucuucauagcccucgucaccguauacaaccuccucuucgaagaggagccaaucgccggcgaaacgugcgaugccaaggcccugcucacagcaaaaacgucuaaaagcaagcgucucgagucccuaaucagcgaguucccgggccagaaaaagaacggccucuucggaaacuuacucgcgcucgcccuuggacugcgacccaacuucaaaucgaacuucggacucucugaagacgccaagcuacaaaucacgaaggacacuuacgaagaagaacucgacaaucuucuggcagaaauaggagaccacuacgcggaccucuuucucgccgccaaaaaccucagcgacgcuauucugcuauccgauauucuuacacuaagugacgaaaacacccgcgcaccacucucggccagcaugaucaaacgcuacgaggaacaccaggaggaccuagcauugcugaaaaagcuaguaaaagaacagaugccagaaaaauacugggaaaucuuuagcaacgcgaagaaaaauggguacgcgggauacauagaaggcaaagugagccaagaggacuucuaccgcuacauaaaacccauacucucgcgccuuaaaggcggcgacgaguuccuagcaaaaaucgaccgcgacgacuuuuuaaggaaacaacgaacuuuugacaacgggagcauaccccaccagauccaccuaaaagaacuacacgcgauacuucgccgacaagaaaaauauuacccauuccuugccgagcagaaagagaaaauagaacaacuacucugcuuccgaaucccauacuacgucggaccacucgcaaaaggcggaaacucgagcuucgccuggcuaaaacgccgguccgacgaacccaucacacccuggaacuuuaaagacguugucgacgaggaagccuccgcccaagcguucauagagggaaugacgaauuacgacaccuaccuccccgaggaaaaaguccugccaaaacacagcccucuguacgaaauguucaccguauacaacgagcucaccaaagucaaauacaucgccgagaacaugaccaagccccuguacuugucagccgagcaaaaggaagccauaaucgaccaccuguucaagcaaacacgcaaagucaccgugaaagaccugaaagaaaaauacuucucacaaauugaaggacucgaaaaugucgacgucacaggugucgagggugccuucaaugccagccuaggcacuuacaacgaccuccucaagauaaucaaggacaaggccuuccucgacgacgaggcgaacgccgaaauacuggaggagauaguccuaauacuaacacucuuucaagacgaaaaacuuauagagaagcgccucgccaaauacgcaaaccuauucgaaaaaucgguccugaagaaacugaggaagcgccauuaucguggguggggccgccucucgcgccaacucaucgacggcaugaaagacaaagccagcggcaaaaccauacuagacuuucugaaggcagacgauuuugccaaccgcaacuucauacaacugaucaacgacucuagccuggacuucgagaaacuaaucgacgacgcacagaagaaagcgauuaaacgugaaucgcucaccgaggcaguagcaaaccuggcaggcagcccagcgauaaagaaaggcauacuccagagccuaaaaguggucgacgagauugugaaaguaaugggacacaaccccgacaacaucgugaucgagaugagucgggagaaccaaaccaccgcacaaggacucaaaaacgccaggcagcgccucaaaaagauuaaagaaguccauaagaaaacaggaagccgcauccuagaggacaacagcgaacgaaucacgaaccucaccuuacaggacaaccgcuuauaccuauaucucuuacaggacggaaaagacauguacaccggacaagaccuggauaucaacaaccuuagccaauacgacaucgaccacauaaucccacagagcuucauaaaggauaacagcauugacaaccuaguccugacuacacaaaaagccaaccgcggaaagagcgacaauguaccaucaauagaagugguaagagauaugaaggaccggguguggcggcgacaacucgccaacggugcgauaagccggcaaaaauucgaccaucuaaccaaagcggaacgcggcggccuagcugacuccgacaaggcccgguuccucagacggcagcuaguagagacccgccaaauaacgaaacacguagcucagcuacucgacagccguuucaacucgaaaagcaaccaaaacaagaagcucgcacgcaaugugaagaucaucacgcuaaaaaguaagaucguaucagacuucagaaaagacuucgggcucuacaagcuaagagaagucaacaacuaccaccacgcacaugacgcguaccuaaacgcaguaguaggcaccgcccuacuaaagaaauaccccaaauuagaagcagaguucguuuacggcgacuauaaacacuucgaccucgugaaacuaauuuccaaaucggacccaucccucggcaaagccaccgccaaaguauucuucuacuccaauaucaugaacuuuuucaaagaagaacucucacucgcggacgggacccucaugaaacguccgguaauagaaacuaacaccgagaccggugagguagucugggacaagguaaaagacuucaaaacaauaagaaagguacucuccuacccccaagucaacauagugaagaagacugaaauccaaagcggggcauucuccaaagaaucgguacucuccaagggaaauuccgacaagcucaucgagcgcaaaaagggcugggacccaaagaaauauggaggauuugacucaccuaacacggcauacuccaucuucguagucgcgaaaguugccaagcgcaaggcccaaaaacugaagaccguuaaagaaaucgucgggauaaccaucauggaacaagccgaguacgaaaaagacaacaucgcguuccucgaaaagaaaggcuaccaagacauucaagagaagcuccugauaaagcuaccaaaguacucccuguucgaacuggaaaacggccgaagacggcuccuugcguccgcaaacgaguuccaaaaaggcaaugaacuagcgcuuucgggaaaauacaugaaauuucucuaccuggccucccgcuacgauaagcucucgucgaaaauagagucggaacagcaaaagaaacuauucguggaacaacaucugcacuacuuugacgaaauccuugacaucgugguaaaacacgccacgugcuacauaaaggccgagaauaaccuuaagaaaauaauaagccuauacaaaaagaaggaggcguacucgauaaacgaacaggcccugaauaugcuaaaccuguucauauuuaccucccuuggugcccccagcacguuuguauucuucgacgagaccaucgacagaaaaagguacaccacaucuucugacguccucaauggcauccugauccaacaaagcauaaccggccucuacgaaaccagaauagaccucagucgauucggcggcgauuga

SEQ ID NO: 6648 - RNA, 4125 nt, Artificial Sequence
  Cas9 variant
augaagaagcagaaauucuccgacuacuaccuugguuucgacaucggcaccaacuccguagggugguguguuacggaccucgacuauaacguacuccgauucaauaaaaaggacauguggggcagccggcuguucgacgaagcuaaaaccgcggcagaacgcagaguccaaagaaacagccggcgccgacucaaacgacggaaauggaggcugaaccuccucgaggaaaucuucagcgacgagaucaugaagaucgacuccaacuucuuccgccgacugaaagaguccucacucuggcuugaggacaaaaacucaaaggaaaaauuuacccucuucaacgacgacaacuauaaggauuacgauuucuauaaacaauaccccacaauauuccaucugcgagacgaauuaauaaagaacccagaaaagaaggacauacgacuaauuuaucuugcguugcauagcauauucaagagccgcggucacuuccuuuucgaagggcaaaaccugaaggagauaaagaacuucgaaacgcuauacaacaaccucaucuccuuccucgaagacaacggcaucaacaaaagcauagacaaggacaacauagagaaacuagagaagauaauaugcgacucaggcaaaggccugaaagacaaagagaaagaguucaaaggaauauucaacagugacaaacagcuagucgcaaucuucaaacucagcguaggcagcuccgucagccuaaaugaccucuucgacacggacgaauacaagaaagaagagguggaaaaggagaaaaucagcuuccgagagcaaauauacgaagacgauaaacccaucuacuacucaauacuaggcgagaaaauugaacuccucgacaucgccaagagcuucuacgacuucaugguccugaacaauauccucucagacuccaacuacauaagcgaagccaaggucaaacuguacgaagaacauaagaaagaccucaagaaccuaaaauacauaauccgaaaguacaacaaggaaaacuacgacaaacucuucaaagauaaaaacgagaauaacuaccccgcguacaucggucucaacaaagagaaagacaagaaagaggucguagagaaaagcaggcugaaaaucgacgauuuaauaaaagucaucaaaggauaccucccaaaaccagaaagaaucgaagagaaggauaaaaccaucuucaacgaaauacucaacaaaauagaacucaaaaccauuuuaccuaaacaacggauaagugacaauggaacguugcccuaccaaauccacgaaguggaacucgagaaaauacucgaaaaccaauccaaauacuacgacuuccucaacuaugaggagaacggaguuuccaccaaggacaagcuccucaagaccuucaaguucagaauccccuacuacgucggcccgcucaauagcuaucacaaggacaaaggcggcaacagcuggauaguccggaaagaagagggaaaaauccuaccauggaacuucgaacaaaaagucgauauugagaaaagcgcggaagaauuuauaaaacguaugaccaacaagugcacguaucucaauggagaagacgucauucccaaggacuccuuccucuacucagaguacaucauccugaacgagcucaacaaaguccaagucaaugacgaguucuugaacgaagagaacaagagaaagauaaucgacgaacuguucaaagagaacaagaaagugucagagaagaaauucaaagaguaccuacucguaaaccaaauagcaaaccggacaguagaacucaaaggcauaaaagacagcuuuaauucaaauuacguaucguacauaaaguucaaagacaucuuuggcgaaaagcuaaaccuagacaucuacaaagaaaucuccgagaagucgauccuauggaaaugucucuacggagacgacaagaagauauucgagaaaaagaucaagaacgaguacggagauauacucaacaaagacgaaaucaaaaagauaaacucauucaaauucaacaccuggggccgccucucggagaagcuccugacgggaaucgaguucaucaaccuagaaaccggcgaaugcuacuccagcguaauggaagcucuaagacggaccaauuacaacuuaauggagcuccucagcucgaaauucacccuucaggaaagcauagacaaugaaaacaaggagaugaacgagguuucguaccgcgaccucauugaagagagcuauguaucgcccucgcuuaaacgagccauccugcaaacccugaaaauuuacgaagaaaucaagaaaaucaccggccgugucccaaagaaggucuucaucgaaauggcgcgcggaggcgacgagucuaugaaaaacaagaaaaucccagcaagacaagagcaguugaaaaaguuauacgacagcugcggaaacgacaucgccaacuucuccauagauaucaaggaaaugaaaaacucccucuccagcuacgauaacaacagccuucgccagaaaaagcucuaccucuacuaucugcaauucggcaaaugcauguauaccgggcgggaaaucgaccucgaccgccuacugcagaacaacgacacuuacgacaucgaccacaucuacccgcgcucaaagguaaucaaagacgacuccuucgacaaccuaguacugguccucaagaacgaaaaugcagagaaaucaaacgaauaccccguuaaaaaggaaauccaggagaagaugaaaucauucuggcgguuccucaaggagaaaaacuucauuuccgaugaaaaguacaaacgccucacaggaaaggacgacuucgaacuccgcggauucauggcgcgccaguuagucaacguccgccagaccaccaaggaagucggaaaaauccuccagcaaaucgaaccggaaauuaaaaucguguacaguaaggccgagaucgccucgaguuuccgagagauguucgacuucaucaaaguacgcgaguuaaacgacacccaccaugcaaaagacgcauaccugaacauagucgccggaaacguauacaauacaaaguuuaccgagaaacccuacagguaccuacaagagauuaaagagaauuacgacgucaagaaaauauacaacuacgacauaaagaacgcaugggacaaagaaaacucucuagaaaucguaaagaaaaacauggagaaaaacacagugaacaucacccgcuuuauaaaagaggaaaaaggugaacucuucaaccucaacccgaucaagaaaggagagaccuccaaugaaaucaucucaauaaagccgaaacuguacgacgguaaagauaacaaguuaaacgagaaauacggcuauuacaccucccucaaagccgcguauuucauuuacgucgagcacgagaagaagaacaaaaaggucaaaacguucgaacggauaacacgcaucgacagcacccuaauaaagaaugaaaagaaucucauaaaguaucuggucucgcaaaagaaacuacuuaacccaaaaaucaucaagaaaaucuacaaagaacaaacgcucauaaucgacuccuaucccuacacauucaccgguguagacucaaacaagaaaguagaacugaaaaacaagaaacaacuauaccuggaaaagaaauacgagcagaucuugaaaaaugcccuaaaauucgucgaggauaaccagggagaaaccgaggagaacuacaaauucaucuaccucaagaaacggaacaacaacgagaaaaaugagaccaucgacgccguuaaagagagauacaacaucgaguucaacgaaauguacgacaaguucuuagaaaaacuuagcagcaaagacuacaaaaacuauaucaauaacaagcuauauacgaacuuccuaaacagcaaggaaaaguucaagaaacuaaaacucugggagaaaucgcucauacuacgugaguuuuuaaagauauucaacaaaaacacguacggaaaauacgaaaucaaagacucacaaacaaaggaaaagcuauucagcuucccagaggacacugggcggauacgacuggggcaaucgucucucggcaacaacaaagagcuacucgaagaaaguguaacaggucuuuuugucaaaaagauaaagcucuga

SEQ ID NO: 6649 - RNA, 4128 nt, Artificial Sequence
  Cas9 variant
auguccaacaaaccauacagcauuggacuggacauaggcaccaauucagucgggugggccgucauaaccgacgauuacaagguccccagcaagaaaaugaaaguccucggcaauaccgauaagcacuucauaaagaaaaaucucaucggugcccuacuauucgacgaaggaacgacagcagaagaccgccgacuaaaaaggacagcccgccgaagauacacgcggaggaaaaaccgccuacgguaccuccaggaaauauucuucgaagaaaugagcaagcuggacucgggauucuuccaccgccuagacgacuucuuccugauuccagaggacaaaagaggcaguaaauaccccaucuuugccacacucgccgaagagaaagaguaccacaaacaguucccaaccauuuaucaccuaagaaaacaacuggccgacucgaaagaaaaggccgaccugcgacuaauauaucuaacccucgcccacaugaucaaguacagaggacacuuccuauacgaagaguccuucgacaucaaaaacaacgacauacagaaaaucuucaacgaguucaucuccaucuacgauaacaccuucgaaggguccucacucucuggccagaacgcgcagauagaggccauauucacggacaagaucagcaaauccgccaagcgagaacgaguacugaaacuguucccggacgaaaagagcacgggucucuucuccgaguuccucaaacucaucgucggcaaccaagccgacuucaagaaacacuucgagcucgaagagaaagcgccacuccaauuccccaaagacacguaugacgaggauuuagagaacguccuaggccaaauaggcgacgacuucgccgaccuauucguagccgccaagaaacuguaugacgccauacugcucuccggaauccuaaccguaaccgacccuucgacaaaagcuccccugucagccagcaugauagaacgauacgaaaaccaccaaaaagaccuugcagcgcucaaacaguucaucaagaccaaccucccagaaaaguacguggaagucuucuccgaccaaagcaaagacggguacgcgggcuauauugacggcaagaccacccaagaggccuuuuacaaguauaucaaaaaccuacuaucaaaguucgaaggaacggacuacuuccuugauaaaaucgagcgcgaggacuuccuucgcaaacaacgaaccuucgacaacggcagcauaccccaucaaauccaccuccaagaaaugaacgccauccugcgccggcaaggagagcacuacccguuccuaaaggagaacaaggaaaagaucgagaaaauccucacguuccgaaucccuuacuacguaggaccgcuagcccgagggaaccgagacuuugccuggcugacacgaaacucggaccaagcaauccgaccauggaacuucgaaaagaucgucgacaaagcgucaagugccgaagacuucauaaauaaaaugacgaacuacgaccucuaccugcccgaagaaaaaguacucccuaagcacucccuucuauacgaaacauucgcaguguacaaugaacuaaccaaagugaaauucaucgccgaaggucuacgcgacuaccaauuucuggauagugggcagaaaaagcaaauuguaaaccaacuauucaaggaaaaacgcaagguaacgaagaaagauauaauccacuacuuacacacgguagacggcuaugacggaauagagcucaaaggcauagagaaacaauucaacgccucccuaucuacauaccacgaccucuuaaaaauaaucaaagauaagaaguuuauggaugacagcaagaaugaagccauacuugagaacauuguacacacgcuuaccaucuucgaggaccgagaaaugaucaaacaaaggcuugcacaauacgacagucuauucgaugagaaagugaucaaagcccucacacgacgacauuacaccggcuggggcaaacugucagcuaagcugauaaacggcauaugcgacaaacaaacagggaacaccauacucgacuaccucaucgacgacggggagauaaacagaaacuucaugcagcuaaucaacgacgacgggcucuccuucaagaagaucauucaaaagagccaaguggucggagaaacggacgacgucaagcaaguagugcgcgaauugcccggcagccccgccaucaagaaaggcaucuugcaguccauaaagauaguggaugaacucguaaaaguaauggaccacgcaccagaaucaauagugaucgaaauggcacgcgaaaaccagaccacagcacggggcaaaaagaacucacaacaacgcuacaagcggauugaagauagccuaaagaaucuagcauccggcuuagacagcaacauucuaaaagagaaccccaccgauaacauccagcugaaaaacgaccggcuuuuccucuacuacuuacaaaacgguaaagacauguauacaggagaggcacuagacauuaaccaacucucuagcuacgacaucgaccacaucaucccgcaagcauucauaaaggacgacucccuagacaaccgcguccucaccagcuccaaagacaauagggguaaaucggacaacgucccgucccuagaggucguucaaaagcgcaaggcuuucuggcaacaacuacucgacuccaaacuaaucucagagcguaaauucaauaaccuaacuaaagccgaacgagggggccuaaacgagcgcgacaaaguuggcuucaucaaacgacaacucgucgaaacacggcagaucaccaaacacgucgcccaaauacuagacgcccgcuacaauacagaagucaacgaaaaagacaagaaaaaccguaccgugaagaucaucacgcuaaaaagcaaucucgucucaaacuucagaaaggaguuccggcuauacaagguaagagaaauaaacgacuaccaccacgcccacgaugccuaucucaacgcugucgucgcaaaagcgauucucaagaaauauccaaaacuugaacccgaguucguauacggggaguaccagaaauaugacuuaaaacgcuacauaucucggucccgaaacccaaaagaaguugaaaaggcgacggaaaaguacuucuucuacuccaaccuucuaaacuucuucaaagaggaggugcacuacgccgacggaaccaucguaaaacgugaaaacauugaauacuccaaagacaccggagaaauugccuggaacacagagaaagauuuugccaccaucaagaaaauccuaagcuacccccaagucaacaucguaaagaaaaccgaggagcaaaccgucggucaaaacggcggucuuuucgacaacaacaucguauccaaagaaaaggucgucgacgcaucgaaacucaucccaaucaaauccggccucucaccaaagaaauacggcggcuacgcacgaccgacaaucgcauacucggugcuagucaccuacaaacaaaacaacaagaucaaaaacaccauggucggaauccccguccuuacgaagcucgaguucgagagggacccaaaccuauaccuccgcaaccugggaaucaauaacguaucacacguuaucaagcuagugaaguauacaguacuagaguucaagcacaaguacggaacuuaccgacguuucauagucuccaaccaggaacugaagagagccaaccaaauauucguuaccaccaaacaaaugaaacugaucagccaauacacgacacuagauaaaaaugaacaugacagucuccucaaaaacaaccaacaacuaauacaaagcauauggaaccaauuccuagaguucaugcucgcgaccgaucucguuaacaagaaacaauacgacgaacucauacucacaaauaaccaaacaaucgaagaaugccgcaacaucaugaacagggugauuaccacccuaucguucaccaacauaaacgcugggcaaaagaaaauaaucuucgacgacacccucucacuucccaucaaacgguggcaauucaccgacagcgacaaaauggucaagaaaauaaucgaaagcacgcucauacaccaaucaaucacgggucucuacgaaacccgcauagaccucagcaaacugggcgaagacuga

SEQ ID NO: 6650 - RNA, 4128 nt, Artificial Sequence
  Cas9 variant
augaaagaauaccacauaggccuagacaucggaacgucaagcauaggaugggccgucacagacagucaauucaaacuuaugaggaucaaaggaaaaaccgcaaucggcguccggcuauuugaagagggcaaaacagccgcagaacguaggaccuuccggacaacacggagacgacugaaacggcgaaaauggaggcugcauuacuuagaugaaaucuucgccccacaucuccaggaggucgacgagaacuuucuccgccgacucaagcaaagcaacauccaccccgaagacccagccaaaaaccaagcauucauaggcaaacuacucuuccccgaccuucucaagaaaaacgagcggggcuacccgacgcucaucaaaaugcgagacgaacuacccguggagcaacgcgcacacuacccagucacuaacaucuacaagcugcgagaagcgaugaucaacgaagauaggcaauucgaccugagggaggucuaccuggcaguacaccacauagugaaguaccgcggucacuuccuaaacaacgccuccguggacaaguucaaagucggacgaaucgacuucgacaaaucauucaacgugcuaaacgaagcguaugaggaacuacaaaacggagaaggcagcuucacaaucgaaccaagcaaaguugagaaaaucggacagcuccuccuggacacaaaaaugcguaaacuggacaggcaaaaagcaguggccaaacuccucgaagucaagguggcugauaaggaggaaaccaagcggaacaagcagauagccaccgccaugagcaagcugguacugggcuacaaggcggacuucgccacaguggccauggucaaugggaacgaauggaagaucgaccucagcagcgaaacuuccgaagacgaaauugagaaguucagggaggaauuaagcgacgcccaaaacgauauccugaccgagauaaccucacuauuuucccaaaucaugcucaacgagauaguccccaacggcaugagcaucucggaauccaugauggaccgauacuggacccaugaacgacaacuagcggaggugaaagaguaccuugcaacacaaccggccagcgcacggaaagaguucgaccaaguguauaacaaguauaucggucaagcucccaaggaaaaaggauuugaccucgaaaaaggacucaagaaaauccucucaaagaaagaaaacuggaaggaaauagacgagcuccucaaagcgggagacuuucugccaaaacagcguaucucagcaaacggagugauaccccaccagaugcaccagcaagaacucgacaggauaaucgaaaagcaggcgaaguacuaccccuggcuagcaacagagaacccggcaacaggggaacgagaccgccaccaggcaaaauacgaacucgaucaacuggucuccuuccgaauaccguauuacgucgggccccuaguuaccccagaaguacaaaaggcaaccagcggcgcaaaguucgcaugggccaagcggaaagaagacggcgaaaucacgccuuggaaccuaugggacaaaauagaccgggcagagagugcagaggccuucauaaagagaaugaccguuaaagacaccuaccugcucaacgaggacguacugccagcgaacagccuacucuaccaaaaguacaauguccucaacgagcuuaacaacguccggguaaacgggaggagacucagcgucggaauaaaacaggacauuuacaccgagcuauucaaaaagaaaaagacagucaaagcuagcgacguagccagccuugugauggccaaaacacgagggguuaacaagccgucgguagaagggcuaagcgaccccaagaaauucaacagcaaccuagccacauaccuagaccucaaaagcauagugggagacaaaguagaugacaaccgguaucagauggaccuugaaaacauuaucgaauggagaagcguauuugaagacggagagaucuucgcagacaaacucacggaaguugaaugguuaaccgaugaacaacgcagcgcccuaguaaagaaacgcuacaaaggcugggggcgacucagcaagaaacuccucacgggcaucgucgacgaaaacggacagcgcaucauagaccucauguggaacacggaccagaacuucaugcaaaucgugaaccaacccgucuucaaagagcaaauugaccaacucaaccagaaagcaaucaccaacgacgggaugacacucagagaacgagucgaguccguacuugacgacgcauacacguccccgcagaauaagaaagccauauggcaaguuguaagaguagucgaagacaucgucaaagccgugggcaacgccccaaaauccauaagcaucgaauuugcacgaaacgaaggcaacaaaggugaaauaacacgaagccggcgcacccaacugcagaaacuauucgaagaccaggcacaugaauuggucaaagacaccagccucaccgaggaacuagagaagguccccgaccugucagaccgcuacuacuucuacuucacacaaggcgguaaagacauguacacaggagacccuaucaacuucgacgaaaucuccaccaaauacgacaucgaccacauacuaccacaaucauucguaaaggacgacucccucgacaaccgcguucucaccucccguaaggaaaacaacaagaaaagcgaucagguacccgcaaaacucuaugcagccaagaugaaacccuacuggaaccaacuccucaaacaaggcuuaaucacgcaaaggaaguuugaaaacuuaacgauggacgucgaccaaacgaucaaguacagaucccuuggcuucguaaaacgacaacugguugaaacccgccaagugauaaagcucacugccaacauccugggauccauguaucaagaagcggguacggacauaaucgaaacacgagcagggcucacaaagcaacuccgcgaagaguucgaccuuccgaaggugcgcgaggucaacgacuaucaccacgccguagacgcauaucuaaccaccuucgcaggccaauaccucaaccgccgguaccccaaacuacgcagcuuuuucgucuacggcgaauacaugaaguuuaaacacggguccgaccucaaguuacgaaacuucaacuucuuccacgaacucauggaaggcgacaaaagccagggcaaggucgucgaccaacaaacuggugaacuaauaacuacccgagacgaagucgcagacuacuucgauuggguccaagaccuaaaauugaugcuggucacaaaggaacuaaaacgcuccaauggcaaacucuucgacgcuaccauacagaacgcgaacuacacgaaacuaaacgaaaggaaaaaggucuuugugccccucaagaaagagcuagacaaaacccuuuacggauccuacagcggcauacaaagcagcuauaugaccaucgucaaaaaguucgacaagaaaggaagcacauacgccguucagcgaauacccgucauguacagcaaacuacuggaacuggagaaagaacaaaguaaacuuaaccgucuaguccaaucuauuguaacaucagacccccaagcacccaacaauuucgaaguacuuaugccaugcguccugagcgggcagcuaguaaucgauaacggccgaaaauucacccuaacaucauaccgcuaccaaugcucaacugcccaacucuuccuccccaagaaagaucuaaaauacauccaaaacaacuucaaagagcucaagaaaacaccagacaagcaggacaaaauauucgaaaccauauaugacgauauacucaagcagguagacaaguacuucagccucuacgacaucaacaaauuccgcagcaagcuacacgacggaaaagacaaauuccucgcccuggaaaauuucggggaaaaggaguccaaggacaaaguaauaaccaaaauccugagaggacuacacgccaacgcggaacgaacaagucucaaagagaucggccuaagcacaccgcuagggcaguuccaaucgggggaaggggguauuacacuauccgacaacaccaaaauaaucuaccagucaccgacuggccucuucgagcgacacguguaccuuaaggaccuauga

SEQ ID NO: 6651 - RNA, 4128 nt, Artificial Sequence
  Cas9 variant
augcgcaaaaaccaagaaccauacaacauaggccuggauauaggaacgagcagcauaggcuggagcauuaugaaugauaacuucgaccugaugcgagucaaagggaagaaaggaauaggaguucgccucuacaacgaagggcaaagcgcagccgaacgccggaugcaccggacagcacgacgccgauacggcaggcgcaaguggcgucuccgccuacuggaggacuucuucgacgagcacauggcagaagucgacgacacguucuucgcgcgacucaaagacagcaauaucagucccaaagacgacaaaaaguaccgcaagagccuccuuuuucccaaauccaaaggcguaaccuaucaagacgacggggaguucuacaagaaauauccgacgauguaccaccuacgcuacgcacuaaugacggagcaccgcaaauucgaccucagagaaauuuaccuggcauuccaccacaugguaaaguacagaggaaacuuccucuaugacaccagcguagacucauuugaggccaaaaaucuagacauuaaggggaaauucgacgagauuaaugaccuccugaguucguacaccgacuucuacguggacaacagcaaugccgcgcuggucgaaagcauacuccuagagaaaaacacaacacgaaaagauaaauccaaaaagaucgcaaaacuacuacacguggaggacaaagaaaaagggaaaaauaagaaggcgaaagaccucgcaacgcaaaucucuaacgccguacucggccuaaaaugcaacuuccaccuaaucuucgaacuacaacaaaaguacucguucgacuuauguucggaaaagaccgaggagaacaucgcgaagcuaagcgaaguccuggacgaaaaccaaaagauguugcuuaugauauugaaagagguccaagaccagguaaugcucaacgcuuucguccccagugguaugucccugucagaagccaugaugcaaaaauacgacgacuacggagaacaacuaaaaaucuaccacgagcuagaacacagcguguccgacgacucagcagcaaaacugcgaggcgccuaccgggacuacaacgacaacauaauuaagaggaucgacggagacaauaaaaaggacaccuucuacaagcgcgugaagaauauccuaacaaagaucuccaaagaauacguagaccaggacguacucgaauccugcggcaagcucaagaagcucauagacgaaaacaaauuauucauacgacagcgcacagcagccaacggaguacucccccaccagcugcaccaaauagagaugcgcaaaaucaucgacaaucagaaagaauauuacccauggcuagcggagccgaacccgaacgaaaagcgccgcgucuacagcaaauacaaaguugaggagcucauagccuuccgcauccccuacuacgucggaccccuaguagacccaaacaaugccgacaagaacaaagaggcccgcuucaguuggauggugcggaagaaagauggagagauaacgccguggaacuucuacgauaaaguugacugggccgaaucggcaaacaacuucauagaacgcaugaaaucaaaagacacauaccuacugggggaagacgucgucccgaaagaaaguaugcuauaccaaaaauaugaaguccuaaacgaacucaacaaucuccggaucaacgacaguggccuaagcgacuccuucgaagacgucaaacucaaacaggcaaucuacaacgaccuauucaagaaacagaaaauaguaaaaauaaccgacuuacaaaacuaccuagugcaaaaccacaaauacuuagucaaaccaaagaucagcggccucgccgacgagaaccgcuuccucucuucacucuccaccuauucggaccucaagacaauauucggagacaaagucgacgaccggaccuacuucaacgacuuugagaaaaugguggaguacucaaccguguucgaggacggccacgacuacaaccagaagcuagacgaauacacauggcugacaaaggaagaaaaauacaaaauaggaaagaagagguaccgcggguggggcaagcuauccaagaaguuguugaccggucuaagagacaaaaacaaccacaccaucauggacaaccuaugggaaaccaacaggaacuucaugcaaauccaaaccgccgacgaguucucgaagcagauugccgaggaaaacgagagacaccuaaaaggcucgguauccgacgccaucaacgauauguauacaagcccagccaauaagaaagccauacgacaaguacuacgcgucgucgaugacauacaaaaagcaaugggauacgccccgucgagcaucagccuugaguuugcgcgagaagacggucccaguguacgcaccgucagccgggccaaccgcaugaaaagcauauacgagaaguaugcaucggaaguaucagaagagguuaugaaagaucuagacggagugaucaaagacaaaaagggucucaaugaccggcucuaccucuauuucgaacaacaagggaaagacauguacuccgggcauccgcuagacuucgacaaggucauaucgggacaggaguacgauauagaccacauacugccccaagccgugaucaaagacgacagucuugacaaucgaguccucaccaccaaagcccucaacaaugacgucaaaaguaaaggagucccaugccggauguucaacggaaugcacuccuucuggaagaaccuguacgacaagggcuucaucagccgucgcaaauuuaacaaucucacuacaaaccccgaaaauauagacaaguauaaaaugaagggcuucgucaaccgacaacucgucgaaacacgucagaucauaaaacucgucgcaaacguccuaaacgacaaauaccagaaugacgacguagacauaauugaagugcgugccgaacugacgcacgacguccguaaacacuucaaauucuacaagaacagaaacgucaacgacuaccaccacgcguucgacgccuaccuuacauccuucaucggccacuaccuauucaagaaauaccccaacuugcgccccuuauucgacuacaaugacuucaugaaagugagcgacaacguauucaaacagcuccgcgggaacaacuuccugggggaguuccuaaacaaaaccggcgacaucauaagcaccgacgggaacuucguccuuaauaaagaagagaugaucaacaaacucaacaaagccuacgcauucaagaaaauccugguaaccaaagaggucggacaaaggacaggagccauguuuaaugaaacgagauaccccgcccccaacagcaggaaggccgcccugaaauaccgucgaaugccgaaaccggacucgcuaaucagugucaaagacuacaagaacacagacaucuacggaggcuacucaggcaaaaaugacgcauacaugguaaucguggacaugggaaaacaguacauggucguaggcgugcccgugcgcuacaccgaaaaguuggacaaauuacgcauaaaacacucagaacucuacagagacgaacuacgaaaaguacuuucacgugacaaaacgcuccuggacagcaagggcaacgucaaaagauucgacauuguacuggaccgcguucucuacggccaauugauagaagacggcaacgaacucuucacacucgggagcucaaaguacaaacgaaacuuccgacaacuuuuccuagacaagcaaugcaucgaaauccuggacucaagcgccacaccccagccuaccgacgaagaacuuauauggguauaugaccaaauccuugacaaagucgacaaguacuucgaacuauacgacaucaaccgacaaagggaaacacuacguaaggguagagcugccuucugcucccuccccaacaucagcaugaaaaaggacgaugugacgaagaaaaagauccucaacgagauccugguagcccuccaugcgaacgaguccgagucaaacugcgaaaagaucggaaagaaggucuucgggcgccuccaggucccaggcggcauaaagcuaagcaaggaagcgaaacucauauaccaaagucccaccggccuauucgagcgaguuguguaucuaaaagaccucuga

SEQ ID NO: 6652 - RNA, 4128 nt, Artificial Sequence
  Cas9 variant
auggaaaacaaaaaguacuccaucgggcuggauauagggacaagcuccauaggcuucgcaguaguggacgaaaacaaccgcguuaugcgagucaagggcaaaaacgccauaggcguaagacucuucucagagggacagccggccgcagacaggaggagcuuccgaaccacccgccggagguuaagccgaaggcgauggcgacuccgacugcuccgggagaucuucgagccauacaucaaccccguagacgaagcauucuucaugcgccucaaagagucgaaccucuccccgaaagacgcaaacaaacauuacagcggcgacauccuguuuaacaaccaaacagaccaagacuuuuacgagaaguaccccacaauauaccaccuucgacacgcacuaaugaccgaacacagaaaauucgacguccgugaaaucuacuuggcuauacaucacaucguaaaguuccgcggucacuuucuaaacgcggccagcgccagcaacuucaccgugggaaaacuaaaucuggaaggaaaauucgacgcgcugaacgaaauauaccaacgcguacucacugaugaccccuucgcgcuucgcaccgacaauuuagaccacauaaaagaaauucucauugacaauaagcgcucgcaggcagacaggcaacgaacccucaccggggacguguaccaaagcucugaagagaaagaaauagaaaaacggaacaaagcaauugccacggaaauacucaaagcggcagugggaaacaaggccaagcucaacgucauaacuaauguagaagucgacaaagaagcugcaaaggacuggagcuugaccuucgacucagagaccaucgacgaugaacucgcaaaagucgaugggcaaaugacggacgacggcagagaaaucaucgaaauccuacggucgcucuacagcggcaucacgcuugccgcaauagucccagaaaaccacacacucucucaauccaugguggaaaaauacaacagccacaaagcgcaccuaaagcuccuaaaagaccugauaaacaacaugacagacacaaagaaggccaagaaccuccgugcugcauacgacggauacaucgacgguguaaaaggcaaagugcuaacccgagacgacuucuacaagcaaauccagggaaaccucgacgacuccgcagaggcccagaaaauccaagacguaauggaccaagacgaguucaugccgaaacaacgcacuaaagcgaacggcagcaucccgcaccaauuacagcagcaagaacuagaccaaaucguugaaaaucaaaaggaauacuacccuuggcucgccgaagaaaacccuaacgagaccagacgcggcgucgccaaauacaaacuagacgagcuugucacauucagaguaccauauuauguagggcccaugauaacagccgaagaccaagaaaaacaaucgggugccuccuucgccuggaugaagcgcaaagagccgggaaacaucaccccauggaacuucgaccagaaagucgaccgaauggccuccgcaaaccaguucaucaaaagaaugacgacaaccgacaccuaccugcucggcgaagacguacuaccagcucaaucccugcucuaccagcgauuugaaguccugaacgaacucaauaagauccguauagacagaaaaccaaucuccauagaacuaaaacagcagaucuucaaugacuuauucaagaaauucaaaaacgucaccauaaagcaccuccaagaauaucucguagccacuggaggauacgacaagcggccaagaaucgacggccucgccgacgagaaacgcuucaacucaggccuaagugccuaccaugaccugcacgggauacugggagccgaagucguggacgcgaaugacaagcaggacgaccuggagaaaaucaucgaauggagcacgaucuucgaagacaagaaaauauacagagccaaacuagacgagcuaacguggcuaacugacagucagaaggaaaaacucgccaccaagagauaccaaggauggggacggcuaucuaagaaacuccuguccggcuugcgcaauuccgaccaccgaucaauucucgacauccucuggaucacaaacgaaaacuuuaugcaaauccaagccgaucccgacuucgccgagcuaguuaaaaacgcgaaccaaggcaugcucggcaaaaacaacucccaagacguaauaaacgacuuauacaccagcccgcaaaacaagaaagccauccgacaaauacugcucguuguacacgacauccaaaacgcaaugcacggacaagcccccgccaaaauccacguagaguucgcccggggugaagaacgaaacccccgucgcucgauucagcgacagcaccagauagaagcagcauacgauaaaguaaccuccgaccuccuagucgacgccggcguccgacaggaacuaaaagacgcaauaaaugacaaacgagacuucaaagacagacuguuucuuuacuucaugcaaggcggucgggauauuuacaacggagaaccaauaaacaucgacagacuuagcucauacgauaucgaccacauccugccgcaagccuucguaaaagacgacucccucaacaaccgcguccugacagacgcagaaggcaaccgacgcaagucagacgcaguacccuccgaacuguucggugcaaaaaugcgcucuacaugggaacucaugcgugagcaaggccuaauuagcaaagcuaaauaccgcaaccucacaaugaaccccgaaaacauaaacgcucacaccgaaaacggcuucaucaaccgucaacuugucgagacacgccaagucaucaaacuagccgucaacauacuggccgaugaguacacagaagacacccaaaucgucagcgucaaggcagaccucucacaccagaugcgagaagacuucgagcuacucaagaaccgagacgucaacgacuaucaccacgccuucgacgccuaucucgccgccuuuaucggcaauuaucuccuagaacguuacccaaaacuucaauccuacuucguauacggcgacuucaaaaaguucagucaaaaggacacaaagaugaggcgguucaacuucaucuaugaucucaaacacuccgaucaaaucgccgacaaaaacggcaagaaaaucuggcacaaaacaaaugaccucgacuacauacgccauuuauucgcauacaagaaaauccugaucagccacgaggucuccgaacgccgcggagcccucuacaaccaaaccguauauaaagccagcgacgauaaagccucaggucaaggcucgaagaaacucauccccauaaaagccaacaaacccacagaaaucuacggaggauacaccgggaaaacgcuggcauacauggcuaucgucaaagucaucaaaggcaagaaaaucgccuacaaagucguuggagugcccaccucugcacucguccagcuagcuggaauagaacauggaagccaagaggagcuuaaccgccucuacgacgucuuaaaaccccaauucacucagcuuaagaaaaauaacaaaacgggagaaaucagcgagacuguaucgaaauucgagauaguuaucccgcgcgucaaguaccagcagcuaguagaagacgacgacaagcucuuuaugauagggagcgacacguaucccuacaacgcucaacagcuaguucuuuccgaaggagcccucaaagucauaaacaacgucuaccgaaaaggcgaaaauuccgauaaacaggaaucauacaaacuagaugacgucuacgacgagauaaucauagccaugaagaaauacuucccccuauacgacaaccgaggcuuccgggaaaaaguagccgaaggcaagagcaccuucgaaaaucuccccaucagcaaugaauuuaaaaauggaaaacuaacgaagauuggcaagaaagagguaaucaaccggaugcuccaaggccuacacgcgaaugcgacaaugacagaucucaaaauccuagggauaaaaagccccuucggguucaugcaacagcccaccggaaucgcccuguccgagaaugcacaacuaauauaucaaucaccgacagaccuauucgagcgcagaguccaacucaacaagauuaaauga

SEQ ID NO: 6653 - RNA, 4128 nt, Artificial Sequence
  Cas9 variant
augaagaagauacuaggacuagaccuaggcaccaccuccaucggcugggcccuagucuacgagucugaaaacacggacgagaaaagcucuauaguucggcucgggguccgagugaacccccugucagucgacgaaaaaggcaacuucgaaaaagggaaagcuauaacaacgaaugccgaccgccaacaaacacacggggcccguaucaaccuccaacgauacaagcuccgccgagaaaauuugaaagacugucuucaaaagcaaggcuggaucggaaccgaggcccugugcgaggaaggaaagaccagcaccuucgagaccuacaugcuccgcgcuaaagccgccgaagaggagaucucgcuccacgagcuuugccggguccuauucaugaugaacaaaaagagagguuacaaauccaacagaaaagcaaauaacaaagaagacgggaagcuguuugacggcaugacagucgcgaagaaacucuaugaagaacaccuaaccccggcugaguacagcuuccaacuacuaaguucaggcaagaaauucaagcaggaauauuacagaucagaccucaaagaagaguucgaccgaaucuggaacgaacaacaaaaguacuacccugagauacucacagacgacuuuaaacagcagcugcaaggaaaaucgaaagggaauacaucaaagaucuuccugggaaaguacgguaucuacucugccgaccugaaaggccucgaccggaaacuccaaccucuuaaguggcgaguagaggcucucaagcaacaagucgacaaagaaguacuagcguucguuaucagugaucucaacggacagaucgccagcaccucaggacugcuaggagccaucucagaccguucaaaggagcuguacuucaacaaacagaccgugggacaauaccuauggaccagccucaaagaaacuccccacguaucaaucaaaaacaagccauucuaccggcaagacuaccuagacgaguucgagaaaauaugggaaacccaggcaacauaccacaaggaacucacccccgaacuaaagcaagaaauaagggacauuaucaucuucuaccaacgcccccuaaagagcaagaaaggacucauaagcgucugcgaacuggaacaacgaaagguaaaagucaccauagacgggaaggaaaaagaaaucuccaucggccccaaagucgcacccaaauccagucccauguuucaagaguuccgaaucuggcaaaaccuaaacaacauccuacuaaucgacaagggaaacaacuccauacaccccuuauacgaagaagaaaagaaccuacucuaugaagaacuauccguaaaagaaaaacugaguaaagcugaagcccucaaaguucugaacaaaaauuccaagcaaugggaccucaacuauaaagaaaucgaaggaaaccggacccaagcaguacucuacgacugcuacaaucgcaucauagucaugaccgggcacgaagaauacaacuucaaaaagcuaaaggcaucggaaauacgguccuacguuaagaccacguuuaccggacucggguucaacacagacauucuggaguucgacagcucccuaacgggccacgaacuggaaaagcaaccaauguaccaacuguggcacuugcuauacucguacgaaucagacaacaguagaaccggcaacgacgcacuucuacguaaauuagaaaccgcauucggguucccaaaagaauacgcagcaguccucuccgauguaguguucgaagacagcuauggcaaccucagcguuaaggccaugagaaaaauccucccacaccuucaagccggucugaacuacucgcaggcaugcgaagaagcgggcuacaaacacagccggcgcagccuuaccaaaaacgaacucgaucaaaaggaguacaaagaaaaacucgagcuccucccgaaaaacucgcuacauaacccaguagucgagaaaauacucaaucaaaugaucaauguuauaaacgcgguuaucgacgaauauggaaagccugacgaaauccgcaucgaacucgcacgagagcuaaaaauuggcgccgccgaacgggaaaacaugacacgguccauaaaucagggcaaugccgaaaauaagcgaauacgagaaauccucgagaaggaguucgccuuaucauacaucucgcgcaacgauauuaucaaauacaaacuguacgaagaacucaaauccaacggauucaaaacacuauacuccgauacauacaucuccaaagacaaacucuucuccaaagacuucgacauagaacacaucaucccaaaggcacgacuguucgacgauucgcuguccaacaaaacuaucgaggcacgagacgucaacauagcaaaaagcaauaaaacagcauucgacuucaucuccgaaaaauacgaccaacaaggcaucgaggccuauaagaaaaagcucgacauccuccuacaggacggaucaauaucuaaagcgaaauacaaucgccuucucaugaaagaagcagacaucccguccggcuucaucgaccgcgaucuacgcgauacccaguacauugcaaagaaagccuacgagauacuuuccgaucugguccguaacgugacuccgaccaccggcgccgugaccagcaggcuuagagaagacuggcaacucguagacgucaugaaagagcucaauuucgaaaaauaccagaagcucggucucguggaagucaucgaggaccgcgacggccgcaaaaucaagaggauaaaggacuggacuaagcgcaaugaucauagacaccacgcaauggacgcgcugaccaucgcguucaccaagccgagcuacauccaauaccuaaacaaccugaaugcgcguucagauaaaaacucauccauauauggcaucgaaaacaaggagcugcaccgggaagacaacaaacuccgguuuaacgcgccccuacccauaaacgaguucagggccgaagccagacgccaccucaaaagcauacugguauccguaaaggccaagaacaaagucaugacgcagaacguaaacgucauaaaaacuaaacacggagucaucaagaaggugcaacucacgccacgaggugagcuacacaacgcaaccuucuacggaaccaagaaacgucccauuauaaaaauggugaaagugggggcagcccuagacgaaguaacaauaaagaaaguuuccagcucguuuauacgggaggcgcuacuagaccgccuacacgaauacaauggggacgccaagaaagcauucacaggccgcaacagcaucgacaaaaacccaauauacaucgacgaggaacacaagaaaacagucccggcccucgucaaaaccauagagugggagauguaccacccuacccggaaacuuauaagccccgaccuaaaaaucgacaaggucauugacaaaggcauuagagaaauacucaaaacccgacucgccaaguucaacggggacgcccaaaaagcauucuccaaccucgacgagaacccaauauauaaagaugaagccaagaaaauaacccucaaacgcgugucgcucgaaggcgugucguccgucauaccccuccacacgcuaaaggaccgcgaaggcaagcuagucgucggcaaagacggcaaaccggugcugggugacuacgugcaaacaagcaacaaccaccauaucgccuucuacauggacgagaacggaaaccugcaagacaacgucgugucauucuucgaggcggccgagcgcaaaagccaaggaguaccagucauagacaaaaauuacaaccacgacaaaggauggaacuuccucuucacaaugaagcagaaugaguacuucguauuuccgaaugaggugacaggauucaacccgagcgaagucgaccuaauggacgaagcaaauuacucaaucauauccccaaaccuguaccgcguacagaaaauguccaaagccagcggacgagacuacugguuccgacaccaccuagaagcaaugcuaaacgacgacccaaagcugcgaaacucaauguucaagcgcaucaccagucuuaaggcucuggaagguauagugaaaguacgaaucaauugcaucggcaaaauaguagcagugggggaguacgacuga

SEQ ID NO: 6654 - RNA, 4128 nt, Artificial Sequence
  Cas9 variant
auguccaacaagagcuauaguauagggcuagacaucggcacuaacuccgucgguugggccgugauuacagacgacuacaaggucccaucgaagaagaugaaagugcuugggaauaccgacaagcacuuuauaaagaaaaaccuaaucggggcccuucuuuucgacgaaggaaccaccgccgaagaccgccgauuaaagagaacggcgcgcaggcgauauacacgccggaagaaccgacuacgcuaccugcaagaaauauucucccaagaaauuucaaaaguagacagcucauucuuucaccgacuagacgauuucuuccuugucccagaagacaaaagaggcagcaaguacccgauauucgcaacacucgucgaagaaaaagaauaccauaaaaaauuccccaccaucuaccaccucagaaagcaccucgccgauaguaaggagaagaccgaccugcgacucauauaccuagcacuugcgcacaugaucaaauacaggggccacuuccuauacgaagaaagcuucgacaucaagaauaacgacauccaaaaaauauuuucagaauucaucagcauauacgacaacaccuucgaagggaaaagccucucaggacagaacgcgcaaguugaagccaucuucaccgacaaaauuagcaaaagcacgaaacgagaaagaguacuuaaacucuucccagaugagaaaucaaccggcuuauucagcgaguuccucaaacucauagucggaaaucaggcagauuucaaaaaacacuuugaccucgaggaaaaagccccccuucaauucucgaaagauaccuaugacgaggaucuggaaaaccuacucgggcagauaggggaugauuucgcugaccucuucuuaguagcgaaaaaacucuaugacgcaauucuacucagugguauacucaccgucaaagaccugucaaccaaggcuccccucuccgcaucaaugaucgagcgcuacgaaaaccaccaaaaggaccuagcggcccucaaacaauucauccaaaacaaccuccaagagaaauacgacgagguauuuagcgaucaaucgaaagacggcuaugccggcuacauugacggcaagaccacgcaagaggcauucuacaaguacauaaaaaacuugcucucgaaguucgagggcgccgacuacuuccuagacaaaauugaaagagaggacuuucuaaaaaaacaaaggacauucgacaacggcuccaucccucaccagauacaccuacaagaaaugaacgcaauaauccggagacaaggugaacacuacccguuccuucaagagaacaaagagaagaucgaaaagauccucacauuccgcauccccuacuacguagggccacuagcaagaggaaauggcgacuucgccuggcucacacgcaacucagaccaagccauacggcccuggaacuucgaagaaaucguagaccaagccucauccgccgaagacuucaucaauaaaaugaccaacuacgaccucuaccuaccagaggaaaaaguccuaccaaaacauucccuucuauacgaaacuuucgccguauacaacgaacuaacaaaagucaaauucauagccgaggggcucacucguuaccaauuucuggauaaaaagcagaaaaaagacauauuugacaccuucuucaaggcggaaaacaaaaggaaagugacggagaaagacaucauccacuaucuccacaacgucgacggcuacgauggaauagaacucaaggggaucgaaaaacaguucaaugcaucacucucaacauaccaugaccuucuuaagaucauaaaagacaaggcguucauggacgacuccaagaacgaggaaauccucgaaaacauaauccacaccuuaaccaucuuugaagaccgagaaaugaucaagcaacgucuagcccaauacgauucucuguucgacgagaaagucauaaaagcgcuaacccgccgucacuacaccggcuggggaaagcugucagcaaagcuaauuaacgggauucgcgacaaaaaaucggggaaaacaauccucgacuaccucauagacgacggcgagaucaaccgcaauuucaugcaacucauccaugacgacggacuguccuucaaggaaauaauacagaaggcucaaguauucggaaaaaccaaugacguaaaacaagucguccaggaguuacccggcucccccgcaaucaagaaaggcauccuacaaucaauaaagauagucgacgagcucgucaaggucaugggacacgccccagagagcauugucaucgaaauggcccgcgaaaaccaaaccacggccagaggaaaaaagaacucacaacaacgcuacaaacgcaucgaagacucacucaagaaccuggccagugggcuagacagcaacauacucaaagaaaacccgacagacaacauucagcuccagaacgaccgccucuuccuguacuaccugcagaacggacgcgacauguacaccggcaagccccucgaaaucaaccaacucucgaacuacgacaucgaccacauaauaccacaagcauuuauaaaagacgacucacuugacaaccguguccuaaccagcuccaaagacaacaggggcaagagcgacaacgucccgucgcuagagguagucgaaaaaaugaaagcauucuggcaacagcucuuagacuccaagcuaauuuccgaacgcaaguucaacaaccuaacgaaagcagaacgcgagcgaggcggccuaaacgaacucgacaaggucggguucaucaaacgccaacuaguagaaacacgacaaaucaccaaacacgucgcacaauuccuagacgcacgauucaacaaagaaguaaccgaaaaagacaaaaaaaaccgcaaugucaagauaauaacccucaagucuaaccuagucuccaacuuccgcaaagaguucggccuauacaaaguccgcgagaucaacgacuaccaccacgcucacgacgcauaccuuaaugccguuuuagccaaggcgauccucaaaaaauacccaaagcucgagcccgaguucguauacggcgacuaucagaaauacgaccuucaacgcuacauauccaaaucucgcgagccuaaagaaguagaaaaagcgacacaaaaguacuucuucuacucaaaccuccucaacuuuuucaaggaagagguucacuacgccgacgggaccauagucaagcgagagaauauugaauacaguaaggacacgggcgaaaucgcguggaacaaggagaaggauuucgcgacugucaaaaaaguccuuucccuaccccaagucaacaucgugaagaaaaccgaaguccagacaggcggcuucagcaaagaaagcauuuuaccgaaggggaacucggacaagcugaucccccgaaagacaaaggagauccuaugggacacgacaaaauacggcggcuucgauucccccguaauugcauauuccauacuacucaucgcugacaucgaaaagggcaaagccaaaaaacuaaaaacugucaaaacucucgucggcauaacaauaauggaaaaagcgacguuugaaaagaacccuaucacauuccucgagaacaagggguaucauaacgugcgaaaggaaaacauacucugccuucccaaauacucacuauucgaacucgaguccggaaggcgccgcaugcuugccuccgccaaagagcuacagaaaggaaacgaaauuguccucccaguauaccuaaccacacuacuuuaccacagcaaaaacguucacaaacuggacgagcccgagcaccuggaauacauacaaaaacaccgcuacgaauucaaggaccugcucaaccucguaagcgaauucagccaaaaguacgugcuggccgacgcaaaccuagaaaaaaucaagaaccuauacgccgauaaugaacaagccgacauagaaauacuagccaacagcuucauaaaccugcugacguucacggcauuaggagcccccgcugcauucaaauuucuuggcaaggacguagacagaaaacgcuacaccacggucucagagauccucaacgccacacucauccaccagucgauaacaggucuguaugagacucgcaucgaccucagcaaauuaggcgaagacuga

SEQ ID NO: 6655 - RNA, 4128 nt, Artificial Sequence
  Cas9 variant
auggaaaagaaauacuccaucggacuugauauagguaccaauucgguaggcugggcaguuauaacagaugacuacaaggucccaagcaaaaaguuuaagguacuaggcaacaccaaccgcaaauccauuaagaaaaaccuaaugggagcacuacuauucgacaguggcgaaacggcagaagccacccgccucaaacgcaccgcaagacgcagauacaccagacgcaaaaaccggauacgcuaccuacaggaaaucuucgccaacgaaauggccaaacucgacgacucguucuuccagaggcuggaagagagcuuccuagucgaggaagacaagaaaaacgaacgccauccgaucuucggaaaccuagccgacgagguagcauaucacaggaacuaccccaccaucuaccaucugcgcaagaaacucgcggacucacccgaaaaagccgaucucagacuaaucuaccuagccuuagcccacauuaucaaauuccgcggucacuuccuaauagaggggaaacuaaacgcggagaacucagacgucgcaaaacucuucuaucaacuaauacaaacauacaaucaacuguucgaggagucgccccuugacgaaauagaaguagacgccaagggaauccuaucagcgagacuuucaaaguccaaaagacuugaaaaacuaauagcagucuuccccaacgagaaaaagaacggccucuucggaaacauaauagcccucgcccuaggacucacccccaacuucaaauccaacuucgaucuaaccgaagacgccaagcuacaacuaagcaaagacaccuacgacgacgaucucgacgaacuacuaggucaaaucggcgaccaauacgccgaccucuucagcgcugccaaaaauuuauccgacgcgauacuccugucggacauccuacgcagcaacucggaagucacgaaagcgccgcuauccgcguccaugguaaagcgcuacgacgaacaccaccaggaccucgcgcuacugaaaaccuugguccgacaacaauuuccagaaaaguaugccgaaaucuucaaggaugacacuaaaaacggcuacgccggcuacgucggcaucggcaucaaacaccgaaaacggaccacgaaacuagccacucaagaagaguucuacaaauuuaucaagccaauacucgaaaagauggacggcgcagaagaauuacuagcaaaacucaaccgagacgaccuacuucgaaaacaacgcacauucgacaacggcucaauaccacaccagauacaccucaaagaacuacacgcaauccuccggcgccaagaggaguucuauccguuucucaaagaaaaccgcgagaaaaucgagaaaauacugacauuccgaauaccauacuacgugggaccccuggccaggggcaacagccgguucgccuggcucacgcgaaaaucagaagaagcaauaaccccauggaacuuugaagaagucguggacaagggcgccagugcgcagagcuucauagagagaaugacgaacuucgacgaacaacuaccgaacaagaaaguacugccaaagcacucccuccuauacgaauacuucaccgucuacaacgaacucacgaaagucaaguauguaacugaacgaaugagaaaacccgaguuccugucaggagaacagaaaaaggcaauugucgaccuccucuucaagaccaaccgcaaggugacaguuaaacaacucaaggaagacuacuuuaagaaaaucgagugcuucgacagcguagaaaucauuggggucgaagacagguucaacgccucacuagguacauaccacgaccugcuuaaaauaaucaaagacaaagacuuccuagacaacgaagagaacgaggacauccucgaagacaucguacucacucugacccucuucgaagaccgcgaaaugauagaagaacgccucaaaaccuacgcacaccuuuucgacgacaaagucaugaagcaacugaaacgccgacacuacaccggguggggacgacuauccagaaaaaugauaaacggcaucagggacaagcaaucaggaaagacgauccuagauuuccugaaaucggacggauucagcaaccgcaacuuuaugcaacugauacacgacgacucccuuacguucaaggaagagaucgagaaggcucaaguuagcggccaaggagacagccuacacgagcaaaucgccgaccuugcaggcucccccgcgaucaaaaagggaauccuacagaccgucaaaaucgucgacgagcucgucaaagugaugggccacaaaccagaaaacaucgucauagaaauggcgagagaaaaccagaccaccacgaaaggccuccaacaaucgagagaacgcaagaaacguauagaagaaggaaucaaagagcuggaaucacaaauccuuaaggagaaccccgucgaaaauacucaacuacaaaacgagaaacucuaccuauacuaccugcagaacggccgcgacauguacguagaccaggaacucgacauuaaccgacuuagcgacuacgaugucgaccacauagucccgcagucguucauaaaagacgacucgaucgacaacaaaguccuaacccgaagcguagaaaaccgaggcaaaagcgacaacguaccgagcgaagaaguuguaaagaaaaugaaaaacuacuggcgccagcuacuuaaugcaaaacugauaacacaacgaaaauucgacaaccucaccaaagcggaaagaggaggacuaagcgaggcggacaaggcaggcuucaucaaacgacagcugguggaaacccgacaaaucacaaagcacguagcacgcauccucgacucccgcaugaauaccaaacgcgacaagaacgacaagccuauacgcgaggucaaaguaaucacacucaaguccaagcucguauccgacuuccgcaaggacuuccaacuuuacaaggugagggacaucaauaacuaccaccacgcgcacgacgcuuaucugaaugccguggucggcacggcacugaucaagaaauauccaaaacucgagucagaguucgucuacggcgacuacaaaguauacgacguacgaaaaaugauugccaaauccgaacaggaaauaggaaaagcgacagccaagagguucuucuacuccaacaucaugaacuucuucaaaaccgaagugaaacucgccaauggagaaauccgcaaaagaccccucaucgagaccaauggcgaaacaggagaggucgucuggaauaaggaaaaggacuucgccaccguccgaaaaguucuagccaugccccaggucaacauaguaaagaaaaccgaaguacaaacagggggcuucagcaaagaaucuauccuaagcaaacgggaaucugccaaacugaucccacguaaaaagggaugggacacacgaaaguacggcggcuucggaucucccaccgucgcuuacuccauccuggucguggcgaaaguagaaaaaggaaaggccaagaagcuaaaaagcgucaaaguccucgucggaaucacaauaauggagaaaggcagcuacgaaaaggaccccaucggguuccuugaggccaaaggauacaaagacaucaaaaaggagcugauauucaaacugccgaaguacagccucuucgaguuagaaaacggccgcaggcgcaugcuagccuccgccacagagcuacaaaaggccaacgaacucguccuaccacaacaccucgugcgccuccucuauuauacacagaacauaucugccaccacaggauccaauaaccuuggcuacaucgaacaacauagggaggaguucaaggaaauauuugaaaagaucaucgacuucucggaaaaauacauacucaagaacaaaguaaacuccaaucucaagucgagcuucgaugagcaauucgccguaagcgacaguaucuugcucagcaacagcuucgugagcuuacucaaguacaccagcuucggugcaucuggcggcuucacauuccuagaccuagacgucaaacagggacgccuuagauaccaaacugucaccgaaguacucgacgccacccucaucuaccaaagcaucaccgggcucuacgagacacggacagaccuaagucaacuaggaggcgacuga

SEQ ID NO: 6656 - RNA, 4128 nt, Artificial Sequence
  Cas9 variant
augaagaaaauccucggacucgaucugggcacuacaagcaucgguugggccuuagucaacgagagcgaaaacaaagacgaacagaguucaauaguccggcucggaguccggguaaucccacucacgguggacgaaaaaggaaauuucgagaaaggcaaagccaucaccaccaacgcugaccgacaacagguccaugcagcucgaaucaacuuacaacguuauaaacuacggagagagaaccucagggacugccugcaaaaacaaggcuggaucggcuccgaaccaaugugugaggacgguaaaagcagcaccuucgaaacauacaaauuacgggcgaaagcagcagucgaagaggucagccuccacgaguucgcccgaguccucuucaugcucaacaagaaaaggggcuacaaaucaaaccguaaagcaaacgacaaagaagaaggcaaacucuucgacggcaugacgaucgccaaaaagcuauacgaagaacaucuuaccccagcagaauacagccuacaacugcuaaauacgggacgcaaguucacccccgaauacuaccgaagcgaccucaucgaagaguucgagaaaaucuggaacgaacaacaaaaauauuacccagaaauacuaacugacgaguucaagcaacagcuugaagggaaagccaaauccaacacaagcaaacuauuccucggaaaauacgggaucuacuccgccgacacaaaaggacuugaccggcgccuucaaccccucaaguggcgaguggaagccaugaagcaacaagucgauaaggacguuuuagccuucgugauaucagacuuaaaaggucaaauagcaaacaccuccggucuacuaggcgccauauccgaccgcuccaaggaacuauacuucagcaaacaaaccaucggccaauaucuaugggccucacuucaggaaaacccacacaucuccaucaaaaaucagccguuuuaccgccaggacuaccucgacgaauuugagaaaauuugggaaacccaagcuacauaccacaaagaacuuaccuccgaacuaaagcaagaaauucgagacaucaucauauucuaucaacgaccccucaaaucgaagaagaaccucaucgccgucugcgaacucgaacaaagaaaagucaaaguaacgguagacggaaaagaaaaagaaaucacgauaggcccuaaaaucgcucccaaaucaagccccauguuccaagaguuccguaucuggcaaaaucuuaacaauauccuccuccucgaucacgaaacaaauuccaaacggccccuguacgaagaagaacgcaaucucuuguacgaggaacuaucgguaaaggaaaagcuaagcaagacagaagcgcuuaagguccuaggcaagaaauccaaacagugggaucucaauuacaaagaacucgaagguaaccgaacccaggccguccuauacgacugcuacaaccgaauuauuguaaugagcggacacgaggaaugcaacuucaagaaacucaaagcauccgacauccggcacuauguaaaaaugauauucaaaaaccuggcauucaacaccgacauacuguguuucgacagcagccugaaaggccacgaguuggaaaggcaacccaugugccaacuauggcaccucuuauacucguacgaaggcgacaacagucguaccggaaacgacgcccuccuacggaaacucgagacgagcuucggauucccaaaagaauacgcagccguccuagccgacgugaucuucgaagacagcuacggcaaucuauccgucaaagccaugcgaaacauacucccgcaucuacaggccggcaaagacuauucgcaggcgugugaagaagccgguuacaaacacucccgcagaucacugacgaaagaggaacugaaccaaaaaguguacaaagaaaaacucgagcuacuaccuaagaacagccugcacaacccgguugucgagaaaauucucaaccaaaugguuaacguaauaaacgccguaaucgaagaauacggcaaacccgacgagaucagaauagaacucgcacgugaccugaaaaucggagccgccgaacgagaaaacaugacacgguccaucaaccaagggaacgccgaaaauaaaagaauccgcgaaauucuugagaaagaguucgcgcuaucauaccuuucgcgcaacgacaucauaaaauauaagcuauacgaagaacucaagagcaacggauuuaagacacuauacucugacacuuacauauccaaagacaaacucuuuagcaaggauuucgacaucgaacacaucauacccaaagcgagacucuucgacgacagccuguccaauaaaacaauagaagcacgcgacguaaauaucgcgaaaagcaacaagaccgcuuucgacuucauauuagagcguuauggggaacaaggugucaagacguacaaaaccaaacuacucagacugcuagaggacggagccauaucaaacaagaaauacaacaaccuacucaaaacagaggcagacauuccauccggauucaucgaucgugaccuacgaaacacacaauacaucgcuaagaaagcauaugagauucucagcgaacuuguaaaaauagugacaccgaccacgggcuccgucaccaauagacuccgagaggacuggcagcuaguagacgucaugaaggagcugaacuucgagaaguaccaaaaauuaggccucgccgacguaaucgaggaccgggacgggcggaaggucaagcgaauaaaggacuggacgaagcgaaacgaucaccgccaucacgcgauggacgcgcuaacgauagccuucaccaaaccauccuacauccaauaccugaacaaccugaacgcacgauccgacaaauccagcagcaucuaugggauagaagucaaagagcugcaccgugaagagggcaaauuccgcuucaacgcuccucucccuaucaacgaguucagggccgaagcaaaacgccaccuaaaguccguccuaguauccaucaaagccaaaaagaaagucaugacacaaaaugugaauaagauaaaaaccaaacacggcaucaucaagaaaguacaacucacaccaagaggggagcuacacaacgcgacguacuacgggacgaagaaacgaccccuaguccgcaugguaaaaguuggcgccgcccuagaugaggcgacgauuaaaagggucugcuccccagcgauccgcgcugcccuccuuaaacggcuaaacgccuacaacggagacgccaaagaagccuucacugggcgaaacagcaucgacaagaacccaauauaccuagauauagaacaaacaaaacugguccccguacuugucaagaccauagaauggggaauguaucauccaauacggaagcgaaucacgcccgaccucaagauagacaaagucaucgacaaagggauccgcgagaagcuaaaagcgcgccuugccgaguucaacggcgaugcgcagaaagcguucuccaaccuagacgaaaaucccauuuacauggaugaagccaagcggaucacccuuaaaagagucagcaucgaaggaguccucagcgccaucccacuacacacucucaaggauaaagccgguaaaccggugaucgggucggacggcaaaccagucuuuggcgacuacguucaaaccucgaauaaccaccacaucgcguucuacaucgacgacaagggaaaccuacaggacaaccccgucaguuucuucgaggcugcagaacgcaaaagucaaggaguaccagugaucgacagacgcuacaacugcgacaagggcuggcacuucguuuucacaaugaaacaaaacgaguacuucgucuucccgaacgaagcaaccggcuuuaucccgagcgaaguggaucuccuagacgaagcuaacuacugcauaaucagcccaaauuuauacagaguucaaaaacucagcaaagcgagcggccgagacuacugguuccgccaccaccuggagaccauguugaacgacgaucuccgacuuaaaaacagcacguucaagcgcauccagagccugaaagggcucgaggacauaguaaaaguccgaauuaacagcauugggaaaauaguagcaguaggaaaguacgacuga

SEQ ID NO: 6657 - RNA, 4128 nt, Artificial Sequence
  Cas9 variant
auggagacaaaauuuaccuauuaccucggccuggacaugggcacggauucccucggaugggcugucaccgacagcuccuaccacauccucagagccaagggcaaagaccuguggggaguacgauuauucccggcggccgagaccucagucgacaggcggacguaccggguaaaccggcgccggaggcaacgggagguagcaaggauaggggcgcucaaagaacucuucgccgacgagaucgaaaaaguagaccccggauucuucguaagacuugacgagucaaaguuccacauggaagaccgcucggagaacaacaaacaaaaguauggccuauucgcagacaaacuguucuccgacgccgaguacuacaagaaauacccaacaauauuccaucuccgcaaagaacuccuagaaagcgaggagccccacgaugugcgccuagucuaccuugcacuacugaacauguucaaacacagaggccacuuccuaaacuccucccugcagauagaaggcgaaaacaguaacaucgccgaaucauaccagauguuugucgacacauuaaaagacgaagaacuagacuuucccgagcaaguuucuggugaacgacuccaggaaaucuuucgcucaagcgacagucgaaagaagaaggucgaaaaccuacuggcggaaaugaaccucucgaagaaacagaaaagggagauccaauuuguaaaccuaaucuguggccuuaaaggcaagcuaagcgaacuauuccccgacaaagaauacgaugaagaacagaaaaagauagccuucagcuuccaagacuccgauuacgaagacaaggagaacacaauccaagagcugcuagacgaaagugaaaugaacaugauauacgcagucaaagcgguacaugacagcggcguucuaucagguaucaugaacggagaaagauaccucagcguugccagagucgcaagcuacgaaaaacacaagaaggaccuacagauacugaaagauauacugaagaaauacgauacaaaagaguacuucgaaauguucagaaacgaauccgagaaaagcgagaacuacagcgcauacgucggcagcgucaaauaccacggaaccuuccgacguggacugagcggugggaaacaggaagaccuauacaaacacaucaagaaggugcugggcaaguucccccaagacgacgaggguguaaccuacguacucgaggaaauagaaacagaauccuuccucccaaagcagcucaccgcauccaacggcgucauccccaaucaggugcacgcaagggaaaugcuagcaauccuaaaacacgccgaacucuauuuaccauuucuacaagagaaagacgacacggggcuaaguguaucagagaaaauccucaaauuauucauguuccaaauaccuuacuacgugggcccgcuaggacaagaguauaaggacaaaaagggcuacaacguaugggccgagcguaaggagccaggaaagaucuauccauggaacuucgaagaaaagaucgacguaaagaaaagcgcggagaaauucauaggucgcaugguccgccgaugcacauaccucaguggagagcaggcccuacccaaacagucccuacucuaugagaaauuccaaguacucaacgagcuuaacaaccuucgaauaagaggggagaaaauacccgugagccucaagcaagaaaucuaccacgaccuauucggagacggcaagaaggugagcaugaccagacuaacaaacuacuugcuccaaaacggggucaucagcagcgaagaaaaggacagcugcaucucaggcaucgauggcggauuccauaacagccucuccagcguugguaaguucaaaggagucuucggcgacacgguacacaccgacgaacaccggaaaaugaucgaagacauaaucuucuggggaacuguauucggagaugggaagaaacucuuaaaggaaaaaguggaagaaguauacggcaaccagcuaacagaagcacaaaagaaacgcauauuuggcuucaaauucucaggauggggacgccucagcaaagcguuccucaccauggaaggcgccuccaaagacaacggcgagaucaagggccuuauccaagcgaugugggacaccaauugcaaccuaauggagcuccuaucagaaagauucacauacaaggacaaacuaaacgagauggucacuaccgccgagaaaccacuaugcgaauggaagaucgaagaccuagacgaaauguaucuuagcgccccuguaaaacggaugguguggcagaccauacgcguggucgacgagguccagcagaucaugggauguccaccaaagcgcaucuucgucgaaaugacccgaucugacggggagaaaggcaaacgcacugucucccgccaaaagaaauugguggacuuauacaaagcgcuaggaaaagagggaaaaaucuggagcgaagaacucaacaacaccccagaaggccaauucaggauaaagaaacuguaucucuacuaccuacagaugggcaagugcauguacacaggagaaucgaucgagcucgaaccacucaugaacgacaaccacuuguacgacaucgaccacaucuacccccgucacuucaucaaagacgacaacaucaguaacaaccugguacuggucaaaaaggaacgaaacgcccacaaaagcgacagcuuucccaucgaacccgaaauccgaaauaaaaugaugccguucuggaaaagccuccgaaagaaaggcuuccuaaccgaagaaaaauacaacagacuaacacgcaugagcgcuuucaccgaugaggaaaaagccgccuucauaagcagacagcuaguagaaaccucgcaagggaccaaagccaucacacaaaucuucaaacaggccuucgcagacagcgagauagucuucucaaaggccagcgucgucuccgcauuccgacagaaauucgacugcuacaaaguccgcugcgucaacgauuaccaccacgcucacgacgcauaccucaacauuguagcgggcaacacguaccgggugaaauuuacauccaauccccucaacuucauaaaagaagcuaagaaaaacccaaauucacgagagaaccgcuacaacauggauaaaaccuucgaaugggacguaacaaggaacggcgaaaccgcaugggucgcacaguccaacgaaaaccccgggacaauccagcuagucaagaaauacuugaacaaaaacagcccgcucauaaccaaaaugguguacgaaaaacauggcgguaucacccaaaaagccaccaucugguccgccaaaaaggccgagagcggaaacaccgacgccuacaucccaguuaagaugaacgacccaagacucgcagacguaaccaaguacggcggagucaccacaaucgccgucgccggguauacccuccucgaauacaaagccgggggcaagacuguccgcagccuagaagcccuacccaucuaucugggaggaagcaagaaucucacugaggaacaaaugguagaauacuucuccaacauccuccagcaggaaaacaaagaaaaaguagugucagacguaauaauacgaaagaaaaugaucccaagcggaagccugaucaaguacaacgguuucuacuacuaccucgccggaaaaaccgggaaccgcauuguccugaucagugcaguccagcucugccuacccauggacaccaugcuuuacauaaagaagauagagaaggcuuguucaacaggaaacuucgaagagaaagacaaaaacgggaaacaagugcugagcaagcaacaaaaugaguuuguauacgaacuaauaauagaaaaguaccaacaaagcauauuuaaaaagaaagugggugccauaggcgacaccaucaucgagaagcgugaaaaauucgccgagaucagccuggaggagcagugcaaggugcucaugcaaauauuccuaaacuuccagucagggauaggggucgaucuuacauccguagacggaucaaacaaaucaggggugacuuaccuuaacaagaaaaucaugaacgcacaggaacucaaacuaaucgaccaguccguaacaggaguuuucucaagagagauagacuuacuaaccauauga

SEQ ID NO: 6658 - RNA, 4128 nt, Artificial Sequence
  Cas9 variant
augaguaacaaaagcuacuccaucggacuggauaucggcacaaacagcguaggcugggcagucaucacagacgacuacaaggucccaagcaagaaaaugaaaguccuaggcaacaccgacaaacacuucaucaagaagaaccugaucggcgcccuccuguucgacgagggcacgaccgccgaagaucgcagacuaaaaagaaccgcccgccggcgcuacacucgaaggaaaaaccgacucagauaucuccaagaaaucuucagcgaggagauguccaaaguagacuccaguuucuuccaccgccuggacgacucauuccuugucccugaagacaagcgcggaagcaaguaucccauauucgccaccuuggccgaggagaaagaguaccacaagaaauuccccaccauauaccaccugaggaagcaccuggcggacucaaaggagaagacggacuuacgccugauauacuuggcccuggcccacaugaucaaauaccgaggacacuuccuuuacgaagaauccuucgacauaaagaacaacgacauacagaagauuuucucagaguucauuuccaucuacgacaacacguucgaagagucuucacuaaucggacaaaacgcccagguagaagcaaucuucaccgacaagauuagcaaaucagccaagcgugagcgcguccucaaacucuuccccgaccaaaaaucaacaggccuguucucggaguuccucaaguugauccuaggcaaccaggcugacuucaagaaacauuucgaccucgaagagaaagcuccccuacaguuuucgaaagacaccuacgaugaggaccuagaaaaccuccugggccaaauccgggacgacuucgcggaccucuucuugguagcgaaaaagcucuaugaugcaauccuccugaguggcauccucacagucaaagaccucuccacaaaagcaccgcuuagcgccaguaugaucgaacauuacgaaaaccaccaaaaagaccucgccgcguugaaacaguucauacagaacaaccugcaggagaaauacgacgaaguguucagcgaccaaucgaaagacggcuacgccggauacauaaacggcaaaacaacgcaagaagcauucuacaaguauaucaaaaaccuccucaguaaguucgaaggcgccgacuacuuccucgacaagauagaacgggaagauuuccuccggaaacaacgcacguuugacaaugggucaauaccacaccaaauccaccuacaagagaugaacgccauccuucaucgacagggcgaacauuauccguuccugaaagagaacaaagaaaagaucgagaaaauccuaauuuuccguauacccuauuacgucggcccgcuugcccgaggaaaucgagacuucgccuggcucacacgaaacucagacgaagcaauccgccccuggaacuucgaagaaauuguugacaaagcauccuccgccgaagacuucaucaacaaaaugaccaacuacgaccucuaccugcccgaagagaaagucuuaccaaaacacucccuacuauacgagacuuucgccguauacaacgagcuuacgaaagucaaauucaucgcagaagggcuaacacgcuaccaguuccuagacaaaaagcagaagaaggacauuuucuacaccuucuucaaagcagaagacaaacgcaagguaacagaaaaagacauaauccacuaccuacacaccguagacggcuacgacggaaucgaacuggagggcaucgaaaagcaauucaacgcaucccugucaaccuaucacgauuuacuuaaaauuaucaaggacaaggaguuuauggaugacgacaagaaugaagcaauccuggaaaacauaguacauaccuugaccaucuuugaagaucgggagaugaucaaacaacggcucgcccaauacaacagccuauucgacgaaaaagucauuaaagcgcucacccgucgacacuacacuggcuggggcaaacuaagcgcaaaacuuaucaauggaauaagagacaaaaagagcgggaagaccauccuggacuaccucaucgacgacggagagauaaaccgcaacuucaugcaacuaauacacgacgacggccucagcuucaaagaaauaauccagaaggcacaagucuucgguaagaccaaugacguuaagcaagugguacacgaacugccgggaucaccggccauuaagaaaggaauccuccaaaguauaaaaaucgucgacgaacuggucaaaguuaugggccacgcuccggaaagcaucgucauugaaauggcccgcgagaaccaaacaacugcccgcgguaagaagaacucccaacaaagauauaaaaggaucgaagacucacucaaaaaccuggccucaggacuggacagcaacauacucaaggaaaaccccaccgacaauguccagcuccaaaacgaccgacucuuccucuacuaccuacagaacgggcgagacauguacaccggaaaaccacuagaaaucaaccaacucuccaacuacgacaucgaucauauaaucccacaagccuucaucaaagaugacagccuagacaaccggguccucacuagcagcaaggacaacaggggcaaaagcgacaacgucccaucccucgaaguuguggaaaagaugaaagccuucuggcaacagcuccucgacuccaaacucaucucugaacgcaaauucaacaaucuuacgaaagcagaacgagaacgcgggggccuaaacgaacuugacaaagucggauucaucaaacgacaacucgucgaaacccgacagaucaccaagcacgucgcacaaauccuggacacacgauucaacaaggaaguuaccgaaaaggacaagaaaaaccggaaugucaaaaucauaacacuaaagucaaaccucguuagcaacuuccggaaagaguucggccuuuauaaaguacgagaaaucaaugacuaccaccacgcgcacgacgcauaccuaaacgcggugguagcgaaggcaauacugaagaaauaucccaaacucgaaccagaguucgucuauggagaauaccagaaauacgaccuaaaacgauacaucucgcgcagcaaagaccccaaagacaucgaaaaggccacagaaaaguauuucuucuacaguaaccuacuaaacuucuucaaagaagagguccaauacgcagacggcaccauagccaagcgggagaacaucgaguacagcaaagacacaggggaaauagccuggaauaaagaaaaggauuucgcgaccgucaagaaaguccugucucuaccgcaaguaaacaucguaaagaaacgagaaguccagaccgguggcuuuagcaaagaaucaauacucccaaaagggaacagcgacaaacucauuccacgaaaaaccaaagauauacucugggaaacaaccaaauacggcggcuucgacucaccagugaucgccuauucgauucugcucauagcagacauagaaaaaggcaagucaaaagaauuaaagacgguaaaaacccugguggggaucacaauuauggaaaaagccaccuucgaagaaaacccuaucacauuccucgagaacaaaggcuaccacaacgugaggaaagaaaacauucucugccuccccaaauacagucuauucgaacuggaaaacggccggcgccggcuacuagccuccgccaaggaacuucagaagggaaacgagaucguccugcccguauaccuaacaacccuccuguaccacagcaagaaccuccacaaacuggacgaaccgggccaccucgaauacauccaaaaacacagaaacgaauuuaaagaccuacuuaaccuggugagcgaguucagucaaaaauacauccuugcggacgccaaccuagaaaagauacaaaaccuauacgccgacaacgaacaggcagacauugaaauacucgcaaacaguuucaucaaccuccuaacguucaccacgcuuggugcccccgcagccuucaaauucuucggaaaagacaucgacagaaagcgcuauacaaccguaagugaaauacugaacgcaacacuaauacaccagagcaucacggggcucuacgagacgcgcauagaccucagcaaacuaggagaggauuga

SEQ ID NO: 6659 - RNA, 4128 nt, Artificial Sequence
  Cas9 variant
auggagaaaagcuauagcaucggacucgacauaggaacgaacucagucggcugggcaguaauuaccgacgacuauaaagucccugccaaaaagaugaagguccucgggaacacagacaagaaauacaucaagaagaacuuacucggcgcacuccuguuugacucgggcgaaacugcggaggucacccgacuaaaacgcacggcacgccgacgauacacccgccgcaaaaacagacucagauaccuccaggaaaucuuugccaaagaaaugacaaaaguagacgagagcuucuuccagcggcuagaagaguccuuucugaccgaugacgacaaaacguucgacucacacccaaucuucggaaacaaggcggaagaagaugcauaccaccagaaguucccaaccaucuaucaucuacgcaaauaucuagccgacucccaggaaaaagccgaccuaagacuggucuaccuggcacuagcccacaugaucaaguacagaggacacuuccuaaucgaaggcgagcugaacgcagaaaacacagacguccagaagcuguucaacguguucgucgagaccuacgacaaaauaguggacgaaagccaccuauccgagauagaaguggacgccagcucuaucuugaccgagaaagucuccaaaagucgccgccuagaaaaucuaaucaagcaauacccgaccgagaagaaaaacacacucuucggaaacuuaauagcacucgcccucggccuccaaccaaacuuuaaaaccaacuucaaacuaagcgaggaugcuaaacuacaauucuccaaagacacuuaugaagaggaccuagaggagcuccucggcaaaguaggggacgacuacgccgaccuauucaucagcgcuaaaaaccucuacgacgccauccuucuuucagggauacugaccguggaugacaacagcacuaaggcaccccuuagcgcgagcaugaucaaacgauaugucgagcaccacgaggaccuggaaaaacucaaagaauuuaucaagaucaacaaacucaaacuguaccacgacaucuucaaggacaaaaccaaaaacgguuaugccggauacauugauaauggagucaagcaagacgaguucuacaaauaccuaaagacaauccucaccaaaaucgacgacagcgacuacuuucuggacaaaaucgaaagggacgauuuccuccgaaagcaacgcacuuucgauaacggaucaaucccgcaccaaauccaucugcaggagaugcacagcauccuacggcgacaaggggauuauuacccguuccuuaaagagaaccaggcaaaaaucgaaaagauacuaacguuccgcaucccuuacuacgucggaccccucgcccgcaaagacagccgcuucgcaugggcaaauuaccauagcgacgagccgauuaccccauggaacuucgaugagguagucgacaaggaaaaauccgcugaaaaauucaucacacgcaugacccucaacgaucucuaccuaccagaagaaaaggugcucccaaagcacagccacgucuacgagaccuuuacagucuacaaugaacuuaccaaaaucaaauacgugaaugagcagggugagagcuucuucuucgacgccaacaugaaacaagaaaucuucgaccauguguucaaagagaaccggaaagugacgaaagcgaagcugcucagcuaccucaacaacgaguucgaagaguuccgcauaaacgaucucaucggcuuagacaaggacagcaagagcuucaacgcaucacucggcacguaucacgaccucaagaaaauucuugauaaaucauuccucgacgacaaaaccaacggccagaucauagaagacaucguccugacauugacccucuucgaagacagagacaugauccaugaacgcuugcaaaaauauuccgauuucuuuacgucgcaacagcuuaagaaauuggaacgaagacacuacaccggguggggacgacucucauacaaacuaaucaacggaaucaggaacaaggaaaauaacaaaacaauacucgacuuucugaucgaugacgggcaugcuaaccgaaacuucaugcagcuaaucaacgacgagagccucaguuucaagaccauaauacaagaggcccaaguggucggagacguggaugacaucgaagccgucguccacgaccucccaggaagcccagccaucaagaaaggaauacuucaaagcgugaaaaucgucgacgaacucguaaaagucaugggugacaacccagacaacaucgucauagaaauggcuagagaaaaccaaaccacaggcuauggccgcaacaagucaaaccaacgcuuaaaacgccuccaagauagccuaaaggaguucggcuccgacauacuaucgaaaaagaaaccguccuacgucgacucaaaaguagaaaacucccaucugcagaacgaccgacuauuccucuacuacauccaaaacggaaaagacauguacaccggagaggaacucgauaucgaucgccugagcgacuacgacauagaucacaucauaccccaagcguucaucaaagacaacuccaucgacaacaaaguccuuacaucauccgcgaaaaaccgaggcaaguccgacgacguaccauccauugaaauaguccgaaaccgccgaucguacugguacaagcuauacaagagcggacucaucagcaaacgcaaguucgauaaccugacuaaggccgagcguggaggcuuaaccgaagccgacaaagccggcuucaucaaacgacagcuagucgaaacccgccaaauaaccaaacacguugcucaaauccucgacgcccgauucaacaccaaacgcgacgaaaaugacaaagucauacgcgacgugaaggucauaacgcucaaauccaaccuaguaucgcaguuccguaaggaguucaaguucuacaagguccgagaaauaaacgacuaccaccacgcgcacgacgcguaccugaacgcagucguaggcacugcgcuacucaagaaguacccgaagcucacgccugaguucguauacggcgaauacaagaaauacgacguacgcaaacuaauagcaaaauccucagacgacuauagcgaaauggggaaagcaaccgccaaguacuucuuuuauuccaaccucaugaacuucuucaaaaccgaaguaaaauaugccgacggacgugucuucgaacguccagauauugaaacaaacgcugacggagaggucgucuggaacaaacaaaaggacuucgacauaguccgcaaaguucuaucauacccacaggucaacauagucaagaaggucgaagcgcaaaccggaggguucagcaaagaguccauacugagcaagggcgacagcgacaagcuaaucccccgcaaaacgaagaaagucuacuggaacacaaagaaauacggaggcuucgacagucccaccguagcauacuccguccuaguagucgccgacauagagaaaggcaaagcaaagaaauuaaaaaccguaaaagaacuggucggaauauccauaauggagcgcagcuucuucgaggagaacccggucagcuuccucgagaagaaaggcuaccacaacguacaagaagacaaacucaucaaacuucccaaauacagccuuuucgaguucgaagguggacgccgacggcucuuagcaucagcaacagaacuacaaaaaggaaacgaaguaaugcuaccagcccaccuugucgaacuacucuaccacgcccaucggaucgacuccuucaacagcacggaacauuuaaaauacguaagcgagcacaagaaagaguucgaaaaaguauugucgugcguugaaaauuucagcaacuuauacgucgacguagaaaagaaucuaucaaagguccgcgccgccgcugaaucgaugaccaacuucucacuagaggagauaucggccaguuucaucaaccugcucacccugaccgcccucggagcacccgccgacuucaacuuccucggagagaagauuccgcgaaaacgcuacacauccacuaaagaaugcuuauccgccacccugauacaccaauccgucaccggccuguacgaaacacgcaucgaucucucaaaacuuggagaagaauga

SEQ ID NO: 6660 - RNA, 4128 nt, Artificial Sequence
  Cas9 variant
augacaaaaaucaaggaugacuacaucgucggccucgacaucggcacggacaguugcggcugggucgcaaugaacucgaauaacgauauccuaaaacuacaggggaaaacagccaucgggagccgacucuucgagggagggaaauccgccgcggaacggcgucuguuucgcaccacucaucggcguaucaaaagacgacgcuggcgccuuaaacuacucgaagaguucuucgauccguacauggccgaagucgacccauacuucuucgcacgacugaaggaaucuggacucaguccucucgauaaaaggaaaaccgucuccagcaucguguucccuacgagugcggaagacaaaaaguucuacgacgacuaucccacaauauaccacuugagauacaaauugaugaccgaggacgaaaaauucgaucuaagagagguguaccucgccauacaccacauaaucaaguacaggggcaacuuccuuuacaacacgucuguaaaagacuucaaagcauccaaaaucgacgugaaaagcucaauugaaaaacugaacgaacuguacgaaaaccuaggacuugaccugaacgucgaguucaacauuagcaacacagcggagaucgaaaagguccuaaaggacaaacagaucuucaaacgagauaaaguuaaaaagaucgcagaacuauucgcuaucaaaaccgacaacaaagaacaaagcaaacgcauaaaagacauaaguaaacaagucgcaaacgcaguacucggcuacaagacccgcuuugacacgaucgcacuaaaagagauaagcaaagacgaacucucagacuggaacuucaaacucagcgacaucgacgcagacucgaaauucgaagcccuuauggggaaccuggacgaaaacgagcaagccauccuacugaccaucaaagaacuguucaacgaaguaacccuaaauggaaucguagaagacgggaacacacuaucggagagcaugauaaacaaauacaacgaucaccgcgacgaccucaaacuccugaaagaagucaucgaaaaucacaucgaucgaaagaaagccaaggagcucgcgcucgcauacgaccuauacguaaacaaccgacacgggcagcuucuccaggcgaaaaagaaacucggcaaaaucaaaccaaggagcaaagaggacuucuacaaagucgucaacaaaaaccuugacgauucgcgggcaucaaaagaaaucaaaaagaagauagagcuagacucuuucaugccaaaacaacgcaccaacgccaauggcgugauccccuaccaauugcagcaacucgagcuagacaaaauaaucgagaaccagucaaaauacuacccguuucucaaggaaaucaaccccgucuccucacaccucaaggaagccccauauaagcuagacgaacucauacgguuccgcgugccguacuacgucggccccuuaauauccccuaacgaauccacaaaagacauccaaacgaaaaagaaccaaaacuucgccuggaugauccgcaaggaggaagggcgcaucacacccuggaacuucgaccaaaaaguagaccgcaucgaauccgccaacaaauucauuaaacgcaugacgaccaaagauacauaccuuuucggcgaagacguccugccugcaaacucgcugcuguaccaaaaauucacaguacucaacgagcucaacaacauccgaaucaacggcaagcggaucucaguggaccuaaaacaggaaauauaugagaaccuguucaagaaacacaccacggugaccguaaagaaacucgaaaacuacuuaaaagaaaaccacaaccuagucaaagucgaaauuaaaggacucgcagaugaaaagaaauucaacagcggucucacgacguacaaccgcuucaagaaccuuaauaucuucgacaaucaaauagaugaccuaaaauaccgcaaugacuucgagaaaaucaucgaauggagcaccauauucgaagacaaauccaucuauaaggagaaguugcguucaauugauugguugaacgaaaaacaaaucaacgcgcucucgaacauacgacuccaaggauggggcagacucuccaaaaagcuacucgcacaacuacacgaccacaacggccagaccaucaucgaacaacucugggacucccagaacaacuucaugcaaaucgugacccaggccgacuucaaggacgcaaucgcaaaagccaaccaaaaccugcucgucgcaaccucaguggaagacauauugaacaacgcguacacgucgccggccaacaagaaagcaauacgacaaguaauaaaagucgucgaugacauuguaaaggcggcauccggcaaaguuccuaaacagaucgccauugaguucacacgagacgccgacgaaaaccccaaaagaucgcaaacccgcgguaguaaacuacaaaagguguacaaggaccucuccaccgagcucgcaaguaaaacgaucgcagaggaacuaaaugaggcaauaaaagacaagaaacucguacaagacaaauacuaucucuacuucaugcaguuaggucgcgacgccuacacgggagagcccauuaacauagacgaaauacaaaaauacgacaucgaccacauccuuccccagagcuucaucaaagaugacgcccucgacaaccggguccucguaagccgcgcagucaacaacgggaaaagcgacaacgucccagucaaacuauucgguaacgaaauggccgcaaaccucggcaugacgauacgcaaaaugugggaagaguggaaaaacaucggacuuaucucaaaaacgaaguacaacaaccuccucaccgaccccgaccacaucaacaaguacaaguccgccggcuucaucaggagacagcucgucgaaacgagccagaucaucaaacuggucuccacaauccuccaguccagauaucccaacaccgaaauuauaacggucaaggcaaaauacaaccacuaccuccgcgagaaguuugaccuguacaagucacgcgaggugaacgacuaccaucacgccaucgacgccuacuugagcgcuaucugcggcaauuugcuguaccaaaacuacccaaaucuccgcccauucuucgucuacgggcaauacaagaaauucucgucugacccagacaaagaaaaagcgaucuucaacaaaacacgcaaauucucauuuaucagccagcugcugaagaacaagagcgaaaacuccaaagaaaucgcaaagaaacugaaacgcgcguaccaauucaaguacaugcucgucagccgcgaaacagagacucgcgaccaagaaauguucaaaaugacaguauacccacgcuucagccacgacacagucaaagcgccaaggaaccuaauacccaaaaagaugggaaugucacccgacaucuacgggggauacacaaauaacuccgacgcauacauggucaucgugcggauugacaagaagaaagggacagaguacaaaauacucggcauuccaacccgugaacucguuaaccucaagaaagcggaaaaagaagaucacuacaaaucguacuuaaaagagauucuaacaccgcgcauccuauauaacaaaaacggaaagcgggacaaaaagaucacguccuuugagauaguaaaaagcaagauacccuacaaacaagugauccaagacggagacaagaaguucaugcugggcuccagcacguacguauacaacgcgaaacaacugacccucucaaccgaaagcaugaaagccaucaccaacaacuuugacaaagauuccgacgaaaacgacgcauuaauaaaagccuaugacgagauccucgacaaagucgauaaguacuugccacucuucgauauaaacaaauucagagaaaagcuccacuccggacgcgagaaguucaucaaacucagccucgaggacaagaaagacacaauacuuaaaguguuagaagggcuccacgacaacgccgugaugacaaagaucccaacaauuggacugagcacaccacuagguuucaugcaauucccaaacggagugauccuaucugagaacgcgaaacucaucuaucaaagccccaccggacuguucaagaaauccgucaagaucucugaccuauga

SEQ ID NO: 6661 - RNA, 4131 nt, Artificial Sequence
  Cas9 variant
auguccaacuucgacaaccacaaagacagcaucugcaagcacaaaggacugaagaaagggaacuacuacaucggacucgacaucggcacgaacuccgucggcugggccgccacaaacgaacaauacgagcuacucaaauuuaagucacacaagaugugggguagccgccuuuucgcggaagcccaaaccgcaguagauacgcgcaugaagaggagugcccgccgccgacugcaaaggcguaaauuccgccuuauacuccucgaaucucuauucagcaaagagauaaacgccgucgaugagacguucuucaugcgccuacacgagagcaacuaccaugucgaggacaagacgaaccuagucaaguauacgcuuuucauagacaaaaacuacaccgacguagacuacuacaaagaguucccgacaaucuaccaccuccgacaccaccuuaugaccgaagggaccaaggacauaaggcuccucuuucuagcgauccaucauauccuaaaguacagaggcaauuucuuguacgggaagaaagaguucagcgucgacggagaaauguauuccguccucagaucgacccucgaagaacucgguuucggcucauacguagaagacgaaaacguacuccaaagcauagccaaccuggugcuagaccgcgggaucgcgcgcucggaaaaaguaaagcaaaucgaaccacugaucgcgcaaggcaaaaagcucuccucgguagagaaaaauagacucaaagccugggcguacuuaaucaugggccuaaaagcgaaccuuguuaaccuauucaccgacgaagacgucgaaguaguccuaccggaagaaaaagaguucaaauccaucaaccuacacgaaggaaucuacgaagauguaagagacgccuaugaagacgccuggggcgaccgcuucgccauaguggaccagugcaaaguacuucacgacauuauagugaucaguagcaucauaaaacccgggcaaucccugucagaggccaagaucgaaucauacaaucaacacaaggaagaccuaguccuauuaaagaguguacugaaggaggacaaaaagcucuaugacgacauguucgucgucgacauugacaaagggacuaauuacguaaaauacauaaaacaaggagucaacgguaacacaagcacgacucaggaagcguucuauaaauauguccgaaaagucguuucgguacugcccgaaaccgaaaacacgcgcugcaucguccagaaacuagaagaaggaaccuuucuacccuugcagaggauauccaagaacggcgucguacccuaccaacuccauaaagaagaacugguacgaauacuugagaaggcgaaacuaaacuucccauuuuugaacgagguugaagaugggcuuacagucgccgacaaaaucaucucgauccuagaguucaaaauccccuacuacgucgggccccucaacccaacacacuccaucgaaaaugggggauucgcguggguaguuagaaaggaagccggacaaguccugcccuggaacuucgaacagaaagucgacguccaggccagcgcaguuaaauucauagaaaaccuaaccaacaagugcaccuaccugaucgaccaagacguucugccaaaauauucccuccuguaugccgaguucucgcugcuaaacgaacuaaacaacauaagagucaaugacaagccacuacccgcagacguaaaacaagcguuuaucagggaccacuucaucagucugcaggacaguaaaacagcgacgaaaaagguagucgcaaaauaccucgucgacaauaacuacgucucacaaccacccauaauaaccgguauggaucaacagaucgcaacgaagcugacaucacacagagacaugaccagaauccuuggugagcacuuugauuacgcaauggccgaagacauuauccgguacaucacaauauucggggaaucgaaagauaugcuacggcagguccucaagaacuauuacggcgaccgccugacaacugaacaaaucaagaaacucgggaaacucacauacacaggcuggggccgcuuaucgaagaaauuucucagcgacauauggggcaugaagaaaaacgacgacgacgccgaagccggcaccauaaucgaacacaugagggagggccaggagaaucucaugcagcuccuauccuccagcuauagcuucauugacgucguacaagaauacgucacaaacguccucggggccaaagagaaaacugccuucgaaaugcucgaagaccuaucccugagccccaugguaaaacgcucuguuuggcaaacccuccgcauccuagacgaaaucgugaguauaagaaaggaacuacccaagaaaauauucguugaaguagcacgcacgaacaaagcggauaagaaacgaacccaaagcaggaaggcccuacucgaagaacucuacgaacagaucaaggacgaggacguccacguacuccagcaagaacucgagagcaaagaagauagcgcccugaacagcaagaagcucuaccucuacuuuacacaaaugggccgauguauguacagcggacggcggaucgacauacacgaacuguuuacagacacguacgauaucgaccacauuuacccacgcucgcucaccaaagaugacuccuggcacaacauugugcuugucgagaaacaacucaacgccgaaaagacggaccgauucccaauccuaagugccauucaaagcaagcaaaagggcuucuggaagcuauugugggaccggggguucaucagugaaaagaaauacgaucgccuuguaaggaccaccgaccugacugacgaggaacucaaccaauucaucaaccgccaaaucguaucaacuaaccaaucagucaaagccgugacuacccuacuacaccagcuuuaccccgaaaccgaaguagucuuuuccaaagccgagaacauaagcgacuuccgccgagauuacggauucguaaagguacgcagcauuaaccaccaccaccacgccaaggacgcauaccugaacauagucgugggcaacgucuaccacgagaaguucacgaagaacuuccucucauucgcuaaacaaaaagggacccacaggaccuacaaucuaacgaaaauguucgaauacgaaaucaagcucacagaagaaagcaagaaagugaucugggaccccaauauccacauggacauagucaagaaaaugaugaaaagcaaugacguacgaguuacccagagagcagugccacaaaaagggggccucuccgacgaaacaaucuacaagaaaggcaucgcgaaacgcggcgucuauuuaccucuaaaaagcucagacgagcgcguacgcgacgucgaaaaauacggaggacgaaccagcauaacaauauccgaauacaucauacuuaacaucagagacaccucagaccaagaccgaaucgaaaucuucucacuaccccuauacauagccgggaagaaagauauccacaaagcgauagaagaagcauaccucucaaccugcaagaaacccgccucagucgucgacauccagauccuguaccgcggacucuauaucggcucaaaaguaaacaucaauggauucaccuacuacaugggugguaaaacaggcagcaacgucucaguagacagcgcggucgacguggucauggacauuacaagcuccguguacaucaaacuacucgagaaaguagcaaucaaaaagauagagaacucaaaaacauuccgcaucgagaacaucaagacauccuacaaccacaaagagguaacagucucaaaagaacaaaacauagcccuuuaccaagaacuccucaagaagcuagauacaccucuguucagcaagaugaaaggaaauaaacuugaagaguuccguacgguagguuucgacacguucaucgcacugucccuagaagaccaggcaagcgugcuucuggaaguccuaaacgucuugaccaacuucaaaaccaagcgcgacauaacaaagaucggaaugaccucuagccgcaguaccuuggggauaaacauaucgaacaccgaacaguucuccgucaucacuaccuccaucaccggccuauacgagcaggaaauuaaaauaaaauga

SEQ ID NO: 6662 - RNA, 4131 nt, Artificial Sequence
  Cas9 variant
augacuaccaaaaaccgagagaaaaauaacaaauuccacaaggcuucgccccucuacacacucgggcucgacauuggcacaacaucagucgguuuuacagccaucgaugaagcccagagaccuaugcgcgcuaagggaaaaacaguuaucggaguccgccuauuccaagaaggucagucagcagucggccgaaagaacuuccggacgaccagacgccgccuaaaaagaaggcgccgaagacucaacuuacugaagcaguucuucuccgcgccacuacgcaagauagaccccaccuucuucaagcgccucaaagccagcagccugucaccagcggauaaacgcagauacuuggccccaggccuguuucccaacggcggcgauauuaaguucuaccaaaaguaccccacgauauaccaccuacgacucgcacuuaugacagaaaaacgacccuucgaccugagagaagucuaucuggcaauccaccacaucgucaaauaccguggcaauuucuuaaauccucuccccgucuccgcauuccguggccgcaaccaaagauucgaagaccaguucagugaacucaaccaacuauacaaguccuuggaaggcgaguccccguuccaauucgacgagaaaaucuucuccgaacuggacaagcagcuauuagucaaugacggacgcaagaucgaccgacaaaaacaacucgcgaagcgaguauuuaucaaaaccaacgagaagcgaaucgacagucaucaccagaaaaucgcaucagccuucucaaaagcuguuuucggcuacaaauuucggcccgacguccuccuaaauagcgacccgaaugaguccauagacgaguucauaaaauucggagacgaagacuucgacgauaaauuaguaauacuacgagaaucacucaacgccacgcaaaaagaaauucuagcagucacucaacguaucuacucacagauaauccuaaaugagaucgucccuucccgggagaccuuaucagaggccauggucucccgcuaccaaaaacaccacagcgaccugcaacuccuaaccgaagcgugcaagaaaaugacuaaagcaaaagcagcacguauacaagccgccuauaccgacuacaucgguaaaggagacggccacaaacuuguccacgaccaguucguggcgcuaaucaaaaagaaucucgacccaucagaggaaggccgagaccucgccgaacgccucgcacaagacgacuucaugccccuccaacgcacaccccucaacagggugauaccccaccaguuacaacaggaggagcucgaccggaucaucgaaaaccaaggcgaauacuaccccuuccuuaagacgcucaaccccaaucggagccgagccggcguagccaacuaccagcuagacgagcuaguuagcuuccgcauacccuacuacgucggaccacucauaacagcgaccgaccagcuccacacuuccggcgcaaaauuugcuuggaugacacgccgcgcagccggagagauaacccccuggaacuucgaccagaaagucgaucgucucgcaucagcaaaccaauuuauacgccagaauaugccaaaggacaaucaccuccucgaagcggacguccugccagcaaauucccucaccuaccaacgcuaccucguacucgacgagcuuaacgcggucaagguaaaucauaaauccuuaaccgucucgcaaaaacaacgaaucuucaacgaccuuuucaaacgucaacgaacagugaccguccuaaaccuccaaaauuauuugaaauccaucgaaaagcugcccacccucccagugauaacagguguguccgacuccgagagauucaagaccacccucuccaccuacuuggacuucaaaaacaucuuuggcggcaaagucgacgacucuucacagaaagaaaaguucgaaaagaucauccucuacgccacuaucuucgaagaucacgcaguuuauaaagcuaaacucgaccaaauagacuggcuaggccaacagcaaaagaccgaccugcucagcaaaaacuaccaaggcuggggacaacugagcgaaaaacugcugcugggccuaaagaaccaagccggccaauccauacuagacgaacucuggcaaacaaacaaacgcuuccgcgaaaucaugaacgaagcacacuucgcaaaacagauaauggcaagcaacgccgcacuucucaggaagaaaggccuugacgacguacucagcacagcauuccucagcccccagaacaagaaagccauacgucaaacaguagaagucguagacgacauaguaaaagccaucggcugcccaccccagaaaaucucacuucacuucucgaaagcaccagcagacgccauacgucacgaacgcgacaaugccaacauaauacuccgcacauacagaaaccuaccagcgaaaaugguagacgaccaacucaaagcagaacuucaagccaccgcagaaaaacaccaaguucuguccgacaaacuuuaucuauacuucacucaacuggguagggaccucuacacuggugaaaugcucaaaaugagugagcuagaaaacgacaugaucgaccauaucaugccccaaaccuuugcauacgacgacagcgucaacaaccgcguacucguaucccaaaaccauuccucccaacuaggaaagaccucuggagaaaagagcgacgcaaaaaugaucagguucuggcaaguacuacgcgacaacaaacucaucuccgaacaaaaguaccaaaaccuaacgcucgacuccgaccaccucaguaaaagcacucgggaacagcugcucaaccgcuaccuagucgagaagaacccaauaacccaauggguugccucagugcuuacggaaaaauacggcgacaacggaacaagaguacucaccaucaacccacgaaugguauaccaaaugcgccgccaauucaaccuagucaacuuacccgaagucaacgacuacgaccauggccuugaugcuuaccuagccgcuuucaucggcaacuaugucgacaggcgauacccacgccuucgaaguuacuucguguacggcgacuuuagcaguuccaaagaaaucgucuuccggcuaaacagauucaauuuccucuucgaccuaggacaggccgaacccaacgaacucacggacugggaaacuggcgaaaugaucugggacaaggcugcugcaaauuccguccugcgcgauguauaccaauacaaauucaugcucaucucacaggcggucuacucaagacaaggugcaauguuuaaccaaacgauauaccccgcaucccaagcagcgggccgucaacucauucccguuaagaaaaaccgcgcaaccaaauuauacggcggcuacucggggaacguugaugcauaccucgcaaucguucggcucggcggacccaaaucggaucaauaccgugucgucggaauccccaccaggauggucggccgacugcaauccgccaugaaacaaggcgccgacaccuacgcaaauacacuacacaaaauacugcaaccgcaauucaccaagcgaaagaaaaacagacaaacgggguacuacgaagagacgaccgaaccguucgcagucauuuuagauaagguauacuaccgacaacucauuaucgacggccaacaaaaauucaugcucggaucaucgacauaccaguucaacgccaagcaauuaguccuaucuucccgggcccgccaaauccuaucaggcgaagagagacuaacagacgagaacgguucucaagaccucaucgacgucuacgacgagauacucaccaaaauagaucgcuacuucgagcuguacgaccaacgacacuuccgccaaucucugcacgacggccgcaagcaauucaucagccuaccaauccacaacguuuacagagcaaauagacugauagaacacggcaaauacgaaacccuaucgcaaauucucaauggccuacacgcgaacacuaugaugacgaaccucagauaccucggcauuuccuccccauuuggaaaauuucagucaccaaacggaauaaaauuauccaaggaugccguccuagucuaucaguccccauccggccucuucgaaagacgcguccgucuccgcgaucucuga

SEQ ID NO: 6663 - RNA, 4131 nt, Artificial Sequence
  Cas9 variant
augaacaacaaacccuacucgauaggccucgacauagguacaaacuccgucggcugggccgucauaacagacgauuacaaaguacccuccaagaaaaugaaaguacuggggaauacugacaagcacuucauaaagaaaaaccuccucggagcccuucuauucgacgaaggcacaaccgcagaagaccgccgucugaaacggaccgcaagacgccgcuacacgcgacgcaaaaaccgccugcgcuaccuacaggaaaucuuuacugaagaaauguccaaaguugauaucuccuucuuccaccgacuagaugacucuuuccuaguccccgaagacaagcgcggguccaaauaccccaucuucgcaacacuagaggaagaaaaggaauaccacaagaacuucccgacuaucuaccaucugaggaagcaucucgccgacuccaaagaaaaagcugacuuccgcuuaauauaccuagcccucgcccacauaaucaaauaccgcggccacuuccucuacgaggagucauucgacaucaagaacaacgacauacaaaagauauucaaugaguucauauccauauacgacaacacauucgaaggcagcagccucaacggccaaaacgcccaggucgaagccaucuucacugauaaaauuucaaaaucagccaaacgcgaacgggugcugaaacuguuccccgacgaaaaauccaccggccucuucuccgaguuccuaaaacucaucgugggcaaccaagcggacuuuaagaaacacuucgaccuagaagaaaaggccccgcugcaguucaguaaggacacauaugacgaagaccucgaaaaccucuugguccagaucggagacgacuucgcagaccuguuccucguagcgaagaaacucuacgacgcaauacuccucucaggaauccuuaccguaacggaccccaguacaaaagcuccacugagcgccuccaugaucgaucgauacgaaaaccaccaaaaagacuuagccgcccucaaacaguucaucaaaaccaaccuacccgagaaguacgacgaggucuuuucagaccaauccaaagacggauaugccggguacauagacgggaagacgacccaagaagccuuuuacaaauauaucaaaaaccuacugucaaaacucgaaggcgccgauuacuuccuagacaaaauagaacgcgaggacuuccuuagaaagcaacgaaccuucgacaacggcagcauaccgcaccagauacacuuacaagagaugaacgccaucauccgcagacaaggcgagcacuaccccuuucuacaggagaacaaagagaaaaucgagaaaauccugaccuucagaaucccguacuacguuggcccacucgcaagaggcaacagagacuucgcauggcugacaagaaacucagaccaggcaauacgcccauggaacuuugaagaaaucgucgacaaggcccgcagcgccgaagacuucauaaacaaaaugaccaacuacgaccuguaccugccugaagaaaaaguccuaccgaagcacucccuccuauacgaaacguucgccgucuacaacgagcuaacgaaggucaaauucauagcggagggccuacgagacuaccaauuccucgacucuggccaaaaacagcaaauagucacacaacuguucaaagaaaaacgcaaggucaccgaaaaggacaucauccaguaccuacacaacguggacucuuacgauggcaucgaacucaaaggcaucgaaaagcaauucaacgcaagccuauccaccuaccacgaccuacugaagauaaucaaggacaaagaguucauggacgacagcaagaacgaagccauacucgagaacaucguccacacacucaccauauucgaagaccgugaaaugaucaagcaaaggcuggcccacuacgcaucgauauucgacgagaaggugauaaaagcccuaaccagacgacacuacacaggaugggggaagcucagcgcaaaacucauuaacggcaucuacgauaaacaauccaaaaagaccauacucgacuaccuaauagaugauggggaaauaaaccgcaacuucaugcaacuaauaaacgacgacggacugaguuuuaaggaaaucauccaaaaggcucaagugguaggaaagaccaacgacguaaaacaaguaguccaagaacuacccggcagccccgcaauuaagaaaggaauacuacaaagcaucaaacucgucgacgaacugguaaaaguaaugggacacgcccccgagucgaucgucaucgaaauggcccgugaaaaccaaacgacagcccggggcaagaaaaauucucaacagcgcuacaaaagaaucgaagacgcccucaaaaaccuagcacacggacucgacagcaauauccuaaaagagcauccgacggacaacauccagcuacagaacgaccgguuguuucuguacuaccugcaaaacgggaaagacauguacacaggaaagucccuggacaucaaucaacucuccucgugcgacaucgaccacauaauaccgcaggcauucaucaaagaugauucccuagacaaucgcgugcugacaucguccaaagacaacagaggcaaauccgauaacguaccaucccuagaaauuguacaaaagcgaaaggcuuucuggcagcagcuacucgacucuaaacugauauccgagcgcaaguucaacaaucuuacaaaagcagagcgggguggccucgacgaacgagacaaaguuggcuucauuaaacgacaacucgucgagacccgccaaauaaccaagcacgucgcccaaauacucgacgcgcgguucaacaccgaagucaccgaaaaggacaagaaagaccgguccgucaagaucauaacacuaaagucaaaccuaguguccaacuuccggaaagaguuccgucucuacaaaguccgagaaauaaaugauuaccaccacgcccaugacccguaucugaacgccgucguagccaaagcaauucucaagaaauaccccaaacuagaaccagaguucgucuacggagauuaccagaaauacgacuuaaaacgauacaucucgcguaccaaagacccaaaagaagucgaaaaggcaacggagaaauacuucuucuacucaaaccuacugaacuuuuucaaagaagaagugcacuacgcggacggcaccauaguuaaacgagaaaacaucgaauacuccaaagacacgggcgaaaucgccuggaacaaagaaaaggacuucgcaaccaucaaaaaggugcuaucacuaccacaaguaaacaucgucaagaaaacagaggaacagaccguaggucaaaacgguggacuuuucgacaacaacaucguauccaaaaagaaggucgucgacgccagcaagcuaacgccgauaaaaucuggccuuuccccagagaaauacggcggcuacgcccgccccaccauagccuacuccguacucguuaucgccgacauugaaaaaggaaaagcaaagaaacucaaacgaaucaaagaaaugguaggcaucaccguacaagacaagaagaaauucgaagcuaauccaauagcguaccuggaggaaugcggcuacaagaacaucaacccgaaucucaucauaaaacucccaaaguacucccucuucgaguucaacaacggucaacgaagacuccuggcaucauccauagaacuccaaaaaggcaacgaacugaucgucccauaccacuucaccgcgcugcuuuaccacgcccaacggauaaauaaaaucucagaacccauacacaaacaauacguugagacccaccaguccgaguucaaagaacuccuaacagccauaauuucgcucucaaagaaauacauccagaaaccaaacgucgaaucgcuacuccaacaagccuucgaccaaucagacaaagacauauaucagcucagcgaauccuucaucucgcuccucaaacuuaucagcuuuggcgcgccaggcaccuuuaaauuccuaggggucgagauaucgcaaagcaacgugcgauaccagucggucagcucaugcuuuaacgcaacccuaauacaccaaucgauaacuggccucuacgaaacucgaauagaccuaucaaaacucggcgaagauuga

SEQ ID NO: 6664 - RNA, 4131 nt, Artificial Sequence
  Cas9 variant
auggacaagaaauacggaauaggacucgauauaggcaccucgucaauaggauggaccguuguagacaaauacggucacauaauucgugugaaagggcaaaccggcauaggagugcgucuguucagggaaggccagacagccgcagaacgacgcacuuuccgaacaaccagaagacgcuuaucucgccgacgauggagacuccggcuccuacgcgaaauuuucgacgaacccauaucugcaaucgacgagaacuucuucgcccgccaaaaagccucaucccuggcaccaggagacgcgcgauaccaacaggccuuccaacuauuuaacgacaggaccgaccaggcguucuacuguaaauaccccacuaucuaccaucuuagacaagcacucaugacugaaucacgccaauucgauaucagggaaaucuaccucgcccuccaccagaucaucaaauaucgcggucacuuccuccucggcggcgccgccaaggacuuccagucagacaaacucgaccucgaggccuacuucacgacaaucaacgcacaacucgccggcauauauuccgacggaaguguccaacucccuacccuagacuggaaccaggccugccaagaacuaacagacaccucucgaacccaaucagaucgcaagaacugguuaguaaaggagcuaaaauccuacggcgacucccaacucaagccaauauacacccaaauugccaacgcuauccucggauucaaaacagaccuagccaagauuaugggaaucaacgacccugaaaaagcccucucauucaacuuagacgcacucgacgaccaccgcgacgaugucgcagagcugcucaccgacgaacagauuccguugguaaaucuucucgccaaacuacacacugcacucgagcucgcagcaauucucccggacggacaaacccuauccgguaagauggucgaaauuuacgaaacgcacaggaaacagcucaaaacguacaaggccuuuauccgccagcugcccgauagacaacaacgccuagcacuuaaacaggcauacgaucacuacaucgaccaggggcuuaaccgagaggcuuucuauagcgaagucaaagcuauccuagaaaaacagaagccacuuaccgccacaggacaagcgaugaagaaagccauggaccaaaacgcauuccuucuaaaacagcgcacaaaaaccaauauugcgaucccauaccagguacaacaacaggaaauggaccaaauaaucgccaaccagucuaaauacuaccccuggcucgcaacaccaaaccccgucaaaucacgaagaguuaucgccccuuacaaacucgacgaacucguaugcuuccgugucaauuacuacgucgggccacucguucagagcaagcccggcgaagccaccaaggaagcgaaguucgccuggaugaccagaaaagacccacaguccaccgucgccauuacccccuggaauuucgaccagcaagucgaccgucaagccagcgcaaacgcuuucauccaacgaaugaaaacaacggacaccuaccuccucggcgaagaugucauacccaaaaacagccuccuauaucaaaaguacgaagugcuaaacgaacucaacaacguccgcguaaacggcgacuggcucgacccgcaacgcaaacaauaccuauuuaaaaagcuauucauggaccagccacaauccgucgucaccgucaaagcucuacagaagacacucguagucaucggagcuugcccaacgcuaccaacaguagaaggccucgccaaccccaagagauuccuaucacagcugaccacauaccacgacuucugcaaacuacuccccgaugacauccaacgcgccgacagacaagccgacauugagaaaaucaucaacuggucgacuaucuuugaagacacagcaaucuucaaagaaaaacuaagagacaucaaguggcucuccgcugaccaaauacgacgccucagcagcagaccgcgguacaggggguggggcagauucagcgccaaacuacuaugcggucuccacgaucgccaaggcaacacgguaauggacgaacucuggcagacuucucgaaacuuuaugcagaucaucagacagucggacuuccagaccgccauagccgccguaaaccaacaggaucucggccgccaagaccuacaacgaguuauagacgaccucuacacaucaccucagaacaagaaggcaauacgacaaguauuagccguuguaacagacauacagaaagccaugcacgggaaagcccccucauggcuauucgucgaaguagccaaaggagcccaaaagaacccgcagcgcacccaaucacgccaaucaaagcuagcggaggcuuauagggaguccgcacgugagcuuguagacgaagcugugaaggaacagcuacugacccuccccgacgaccgucaaacguucucagaccgacuuguccuauacuuccaacagaacgggcgcgacaucuacacuggcgaaccgcuggacuucgaacggcuaucgaacuaccacaucgaccauauaaucccccaagccgucgucaaggacgacucacuugacaaccgaguacucaccucuaaccaggccaaccuagagaaaggagcccacguccccacaaucuuccgcgacaaacaagaacccguuuggcaagagcuauacagggucggccuaaucucccaccggaaacucaggaaucuccucacaacccccgacgaccuugacgaccgcggccgagccaccggcuucauugcacgccaauuaguggaaacgaggcagguaauaaaacuggucauggaaguacucagccaguacuacgacacaaccgaaacugaacucauaucgauaaaggcagggcucucacaccaguuccggcaagaacucaaccuccccaaacuacgcgcccuaaaugacuaccaccacgcgcaagaugcuuaccucgcggcccgaauaggcacauacuugcuccaaagauaccccaaccuaaaacgauucuuuguauacggcgacuucaagaaaacgcauuuugaccuccagaggcgcuucaauuuuauugguggcaugaucucacgagagaaacaaccauacaaccuaauaaagaacccggugacccaccaagucauaugggacgaagaaauggaaauuggcgacugucaaaagaaaaacccugagcaaccgaaacacgacgccaccguaaaaaugaugaaucuaacuaaaaucaugaaucuaaaacauauacuggucacucaugaagucuacgaaaaccauggcgcccucuucaaccagacaaucuaccccgcgucgcaggcccauaaaaagaaacucaucccccagaaaacagaaaagcccaucgagcuuuaugggggacacagcagcgagcaagcuggcuacauggccaucauaagacugcucggaaaacgaccaggguauaaagucaugcgcgugccaguuagauacguaucgcaacugcaacaccaggacgucgccgaacagaagaaacuccuguacaagaucuuuguauccgaacuaacgucccgcaacaaagucaaaccauucgaaguagucguaccccaugugugccuaaaccagcccguggaagacaugaucaagggacaauggcacagauucgcuuuaaggaccaacggcuacuaccaaaaccaacagcaacugauucucagccucguagcacagcgaacccuggcaggguacaagccaaaagacgacgaacuuauggcagucuaccacgaaaucuguaaacaggucaaauacuacuuuccccuauacaaaaugaacaaauuccaaagccgauuauucgcagccgaggaauuacuccaaaagagaucaacaguaaacagcuucagcauaaccauagguaaaaacggaaaagagaacaagacccuaaaccucggcaagcgcgagcuacuccucaggcugcuaggaggacuacacgcaaacgccacacgcguggaccucaaagacaucggauguaccggccaauucggccaacuacaagucaaaaacggaauaaagcucaccgagcaagcuguuuuaauucacgaaagcccaacaggccuguuccaccgccgagucaggcugaacgaccuuuga

SEQ ID NO: 6665 - RNA, 4134 nt, Artificial Sequence
  Cas9 variant
augaccaaaaagaacuauagcaucggacucgacaucgggacaaacucaguggggugggccgucauaacggacgacuacaaagucccagcgaaaaagaugaagguacucgguaauaccgacaagaaauacaucaagaaaaaccuacugggcgcacuccucuucgacuccggggaaaccgccgaagcaacgcgacucaaacgcacggcucgacgacguuacacacggcggaaaaacaggcuucgguaccugcaggaaauuuucgcggaagaaaugacgaaaguggacgaguccuucuucuauagacucgacgagagcuuucuaacgaccgacgagaaggacuuugaacgccacccaaucuuuggcaauaaggccgacgagauaaaguaucaccaagaguucccaaccaucuaucaccuccgaaaacaccucgcggacaguagcgaaaaagccgaucuucggcuagucuaccuggcacuagcccacaugauuaaauuccgaggccacuucuuaauagaaggcgaacuaaacgccgagaacaccgacguccaaaagaucuucgcagacuucgucggaguauacgaccgaacuuucgacgacucacaccucuccgaaaucacaguagacgccgcaucaauccuuacggagaaaauuagcaaaucacgaaggcucgaaaaccuaaucaaguauuacccaaccgagaaaaagaacacacuguucggcaaccucaucgcccuagcccucggacuacaacccaacuucaagaugaacuucaaacuguccgaagacgccaagcuccaguucagcaaagacuccuauaaugaagaccucgaagaacuccuuggcaaaaucggggacgacuacgcugaccuauucacguccgccaaaaaucuuuacgacgcgauccugcugagcgguauucucaccgucgacgacaauagcacaaaagcuccucuaucagccaguaugauaaaacgguacgcagaacaccaugaagaccuugaaaaacucaaggaguucauaaaagcaaacaagucugaacucuaccaugacauuuucaaggacgaaaccaaaaacggauacgccggauauauugagaaugguguaaaacaagacgaguucuacaaauaccucaaaaacacacuaucaaaaauagccggcagcgacuauuucuuggacaaaaucgaacgugaagacuuccugcgcaaacaaaggacauuugacaacggcagcaucccccaccagauccaucuacaggagaugcaugccauccuaaggcgccaaggugacuacuaucccuuccuaaaagaaaaccaagaccgaauagaaaagauacuaaccuucagaauacccuacuacguuggcccccuagcaaggaaagauagcagguucagcugggcagaauaccacucagacgagaaaaucacacccuggaacuucgacaaaguaauagacaaagaaaaguccgcggaaaaauucaucacccggaugacccugaacgaucucuaccuacccgaagaaaaagugcuacccaagcacagccacgucuaugaaacuuacgcaguuuauaacgaacucacaaaaauuaaguacguaaaugaacaaggcaaagacuccuucuuugacagcaauaugaaacaggaaauauucgaccacgucuuuaaagagaaccgcaaagugacuaaagaaaaacuucuaaacuaccucaacaaagaguuccccgaguaccgcauaaaagaccuaauagggcucgacaaagagaacaagucguucaacgccagccuuggcacauaccacgaccuaaagaagauacucgauaaagccuuccuagaugacaaagucaacgaagaagugauagaggacauuaucaaaacgcucacacuauucgaagacaaggacaugauccacgagcgccuccaaaaauacucugacauuuuuaccgccgaccaacucaagaaacucgaacgccgccacuacacaggauggggccgacuuuccuauaaacucaucaaugggauccggaacaaagagaacaacaaaacgauccucgacuaccucaucgacgacggcagcgccaaccggaauuucaugcagcucauaaaugacgacacucuccccuucaaacaaaucauccaaaagagccaggucguaggcgacguggacgauauagaagcagucgugcaugauuuaccgggcucaccggcgaucaagaaaggaauccuccaguccgucaaaauagucgacgagcucgugaaaguaaugggugacaaccccgauaacauaguaaucgaaauggccagggaaaaccaaaccacaaaccgaggccguagccaaagccaacagcgucugaaaaagcuccaaaacagccucaaagagcucggcagcaacauacuuaacgaagaaaaaccgucauacaucgaggacaagguggagaacucacaccuucaaaacgaccaacucuuccuauacuacauccaaaacggcaaggacauguauaccggcgacgaacuugacauagaccaucucucagacuacgacauugaccacaucauuccacaagccuucaucaaagaugacucaaucgacaaccgcguccuaaccagcagcgccaaaaaccgcggaaaauccgacgacguacccucgcuggacaucguaagagccaggaaggccgaguggguacggcuuuacaaaucgggucucauuagcaagcguaaauucgacaacuugacaaaagcagagcgcgggggacucaccgaggcggacaaagccggcuucaucaaaagacagcuuguugaaacgcgacagauaaccaagcacgucgcacaaauacuagaugcgcgcuucaacacggaguccgacgaaaacgacaaagucauccgcgacgucaaagugauaacacucaagaguaaccuagugucccaauuccguaaagacuucgaguucuauaaggugcgggaaauaaacgauuaccaccacgcgcacgacgcauaccugaacgccgucguaggaacagcacuacuaaagaaauacccaaaacuagcaagcgaguucgucuacggcgaauacaagaaauaugacguacauaaacuaauagcuaaaucgagcgacgaucauuccgaaaugggcaaagccaccgcaaaauacuucuucuacagcaaccucaugaacuucuucaaacgcgucauccgauacucaaauggaaaaguuaucguacgcccgguaguagaguacuccaaagacaccgaggacauagcuugggacaaaaaguccaauuuccgcaccaucugcaaaguucucaguuacccucaaguuaacaucgugaagaaagucgagacgcaaaccggcggguucucuaaagaaucaauucuacccaaaggggacagcgacaaacucaucccaagaaagaccaaaaaggcuuacugggacaccaagaaauauggaggauucgacucccccacagucgcauauuccguguucgucguagcagacgucgaaaaagggaaagcgaagaaacucaaaaccgucaaggagcucgucggcaucucuauaauggagcgcucguuuuucgaagaaaacccugucgaguucuuagaaaacaagggcuaccacaacauccgagaggacaaacucauaaaauugcccaaguacucacuuuuugaguucgaaggcggaaaacgucgacucuuagccucagcgucggaacuacagaaagggaaugaaaugguaauucccggccaccugguaaaacuccucuaccacgcccaacgcauaaauucguuuaacagcacaaaauaccuggacuacguaucggcccacaagaaagaguucgaaaaaguguuaucuugcguagaagacuucgccaaccuguacgucgacgucgagaaaaaccucucaaagauccgcgcaguagccgauagcauggacaacuucagcauagaagaaauaucgaacucuuucaucaaucuucuaacccucaccgcguuaggcgcgccagcagacuucaacuuucucggagagaaaaucccccgaaagcgcuacacaucuaccaaagaaugccucaacgccacacucauacaucaauccaucaccggccuauacgaaacgcgcauagaccucucgaagaucggcgaagaauga

SEQ ID NO: 6666 - RNA, 4134 nt, Artificial Sequence
  Cas9 variant
augaagaaaccguacaguaucggacucgauaucggaacaaauucuguagggugggccgucauaacggaugauuacaaagucccauccaaaaagaugaagguccugggaaacaccgacaagcacuucauaaagaaaaaccuuaucggggcccuguuguuugaugagggcaccacagcagaagauagacgccuaaaacgaacgagccgacgacgauacacccggcguaaaaauagacuccguuaccuacaggagaucuucagcgaagaaaucagcaaacucgacagcuccuucuuccaccgacucgaugauagcuuccuaguaccggaggacaaacgaggcuccaaauaccccaucuucgcgacacuugaagaggagaaagaauaccauaagaaauucccgaccaucuaccaucugcgaaaacaccuugccgacaguaaagagaaaaccgaccuacgacucaucuaccucgcacucgcacacaugauaaaauacaggggccacuucuuauaugaggaguccuuugacaucaaaaacaaugacauacagaaaauuuucaaugaguucaucagcauauacgacaacacguucgaggggucaucccucaguggccaaaacgcacaaguagaagccauauucacagacaaaaucucgaaaagcaccaaacgcgagcgaguacuuaaacuauuuuccgacgaaaagaguacaggccucuucagcgaguuccucaaacuuauagucgggaaccaagccgacuucaaaaagcacuucgaccucgaagaaaaagccccgcuccaauucuccaaagacaccuacgacgaagaccuggaaaacuuacucggacagauaggagacggauucgccgaccuguuccuaguagccaagaaauuguacgacgccauccuccuauccggaauccuaacugucaccgauccauccacaaaagccccgcuauccgcauccaugaucgaacgcuacgaaaaccaccaagaggaccuggcagcccuaaaacaauucaucaaaaacaaccuuuccgagaaauaugcggaaguuuucagugaccaaucaaaagacggcuaugcaggguucauagaugggaagaccacccaggaagcguuuuauaaauacaucaaaaaccugcucuccaaacuugaaggagcggacuacuuccuaaacaagauagagcgcgaggacuuccuccggaaacaaagaacuuuugacaauggcucaaucccgcaccaaauucaccuacaagagaugaacgcgaucuuacgacgacaaggagagcacuaucucuuccucaaagaaaaucgcgagaaaaucgaaaagauucucgccuucagaauaccuuacuacgucggcccacucgcaagaggcaaccgcgacuucgcauggcuuacccgcaacuccgaucaggccauacgaccguggaacuucgaagaaguaguugacaaggcauccucggcggaagacuucaucaauaaaaugaccaacuacgaccuguaccugcccgaagaaaagguacugccaaagcacucccuacuuuacgaaacauucgcaguguacaaugagcuaacgaaagucaaguucaucgcugagggccuccgcgacuaccaguuccuggacucaggacaaaagaaacaaaucgucaaccaacucuucaaagacaaaagaaaagucaccgaaaaagacauuauccauuaccuacauaacguggacggcuacgauggcaucgaacucaaggggaucgaaaaacaguucaacgcuagucucuccacguaccacgaccuccucaaaaucaucaaagacaaggaguucauggauaacccgaagaacggagaaauccuagagaauaucauccacaccuugacgaucuucgaagaucgcgagaugaucaaacaacgucucgcacaauaugacacgcuguucgacgagaaggucauaaaggcacucacccgccgacacuacaccggauggggcaaacuaagcgcaaaacuaaucaacggcauacgcgacaaacaaacaggaaaaacgauucucgaauaccucaucgaugacggggacugcaaccgaaauuucaugcaacucauaaacgacgacggacuuaguuucaaagagauuauccaaaaggcacaaguggucgggaaaacagacgaugucaaacaggucgugcaagagaucccgggcucccccgcaaucaagaaaggaauauuacaaucgaucaaaaucguagacgagcucgugaaggucaugggccacaaccccgaaucaaucgucaucgagauggcccgugaaaaccaaacgaccgcaaagggcaagaaaaacucacaacaaagguacaaacggaucgaagacgcacuuaaaaaccucgcuccaggccucgacuccaauauucucaaagaaaaccccacugacaacauccaacuacaaaacgaccgccucuuccucuacuaccuacaaaauggcaaagacauguauaccgguaaagccauagacauaaaccagcuaucaaacuacgacauugaccacauaauaccucaggcauuuaucaaggaugauucccuggacaaccggguacucacauccagcaaagacaaccgcggaaaaagcgauaacguacccagcaucgaaguugugcaaaaacggaaagccuucuggcaacaacuucuggacucgaaacucaucucagaaaggaaauuuaacaaucucaccaaagcaaaacgcggagggcucgaugaacgagacaaagucgguuucaucaaacggcaacucguagaaaccagacaaaucaccaaacacguagcgcaacuccuagacacacgcuucaauacagaagugaacgaagagaaccaaaagauccgcacagucaaaaucaucacccucaagagcaaucuagucuccaauuuccguaaagaguucgggcuauacaagguacgagaaaucaacgacuaccaucacgcgcacgacgcauaccugaaugcggugguagcgaaggcgauacugaagaaguacccaaaacucgagcccgaguucgucuacggagacuaccaaaaauacgaccuaaagcgcuacauacugaaaucgaaagccucgaacaccaucgacaaggccaccgagaaauacuucuucuacucuaaccugcuaaacuuuuucaaggaaaaaguccgauacgccgacgggaccaucaagaaacgugagaauauagaauauucuaacgacacgggagagaucgcguggaacaaagagaaagacuuugcaaccaucaagaaaguucuaucccucccccagguaaacaucgucaagaaaaccgaagaacagacagucggucagaacggcggacucuucgacaauaacaucgucagcaaaaagaaagucgucgacgccuccaaacuuaucccaaucaaauccuccuuaagcccagaaaaauacggcggcuacgcgcggccuaccauugccuacucaguccucguaaucgccgacaucgaaaaagguaaaggaaaagcgaagaaacuaaaacgaaucaaagaaauagucggaaucacuauccaagacaagaaaaaguucgaguccaacccuguuaccuaccucgaagagugcgguuacaagaacauaaauucgaaccuaaucaucaagcugccaaaauacagccuauucgaguucaacgacggacaacgccgcuuguuagcaucauccaucgaacuccaaaaagguaacgaacucauacuaccauaucaccugaccgcgcugcuguaccacgcacaacgaauaaacaaaaucucggaaccaauacacaaacaguacgucgaagcgcaccaaaacgaguucaaagaacugcuaacaaccauaauaucccugagcaagaaauauauacaaaagcccaacguagaacuacuucugcagcaagcguucgaccaagccgacaaagacauauaccagcucucugaauccuucaucucucuacuaaagcucaccucguucggagcccccggcgcauucaaauuccucggaguagagauaagucaauccagcguacgauacaagccgaacucccaauucuuagacaccacccugauacaccaauccaucacaggccucuacgaaacccgaaucgaccucuccaagcucggagaggacuga

SEQ ID NO: 6667 - RNA, 4134 nt, Artificial Sequence
  Cas9 variant
augaacaacaagccauacagcauaggccuagacaucggaacaaacagcgucggauggagcgucauaacugaugacuacaaagugcccucgaaaaagaugaaaguacuuggcaacacagacaagcgauucaucaagaaaaaccucauaggggcccuccuguucgacgagggaaccacagccgaggcccggcgccucaaacgaacagcaagacggagauacacuagaaggaaaaaccgacuccgauaucugcaggaaauuuucgccgaagaaaugucaaaaguagacagcucauucuuccaccgacuagacgacucguuccucaucccagaagacaaacggggguccaaauacccgaucuucgccacgcuagucgaagagaaggaauaccacaaacaguucccgaccauauaccaucuccgcaagcagcuggccgauagcaaagaaaaggccgacuugcgccuaaucuaccucguccucgcucacaugaucaaauaccgaggacacuuccuguacgaagaagccuuugacaucaagaacaacgacauucagaagauuuucaaugaguucaucagcauauacgauaacaccuucgaaggcucaucacucagcggucagaacgcccagguggaaaccaucuucaccgacaaaaucucaaaaucggccaaacgcgaacgcguccuuaagcuauuccccgacgaaaaauccacagggcuauucagcgaguuccucaaacuuaucgugggcaaucaggcagacuucaagaaacacuucgacuuagaagaaaaggcaccccugcaauucuccaaagacaccuacgacgaagacuuagaaaaucuccucgaacagauuggcgacgacuucgccgaccuauucgucgcagcuaagaaacuauaugacgccauccuucucucagggauucuaacaguaaccgaccccucaaccaaggccccacuguccgcgucgaugaucgaacgauacgaaaaccaccaaaaagaccuggcaguucucaaacaguucaucaaaaccaaccugcccgaaaaauauguagaagucuucucagaccaaucgaaagacggauaugccggcuacaucgacgggaagaccacccaagaagcguucuacaaauacauaaagaaccuccugucgaaauucgacggggcggacuacuuccuagauaaaaucgagcgcgagguauuccuccggaagcaacgaacguucgacaacggcuccauaccacaccaaauucaucuccaagaaaugaacaccauccuccgaagacagggagaacacuaccccuuucucaaagagaacaaagaaaagaucgagaaaauccugacauuccgaauccccuaccacguaggaccccuagcucgaggcaaccgagacuucgccuggcugacaagaaacucagaccaagcaauacgccccuggaacuucgaagagauaguagacaaggcuuccuccgccgaagacuucaucaacaaaaugaccaacuacgaccuuuaccucccagaagaaaaaguacugcccaaacacagcuuacuguacgaaacauucgcaguauacaacgaacuuaccaaagugaaguucauagcagaaggaaugcgcgacuaccaauuccucgacuccgggcagaagaaaaagaucaucaaucaacuuuucaaaaagaaaagaaaagugacggaggacgacauuaucgacugcuuacagaaaaucgacaacuacgacggaauagaacuaaagggcauugaaaaacaauucaacgcuucacucuccacuuaccacgauauccucaagauuauccgcgauaaagaguucauggacgaccccaaaaacggggacauccuagaaaaugucauacacacccucaccaucuuugaagauagggagaugaucaaacaacggcucgcccaguauaauuccaucuucgacgaaaaggucauaaaggcacucagcagaaagcacuacaccggaugggguaagcuguccgcaaaacucaucgacggcaucagagacaagcagaccgguaaaaccauccuagauuaccuuauggacgacggaaaaagcaacagaaacuucaugcaacuaaucaaggacgacgaacuuuccuucacugagaucauccaaaaagcacaaguaguaggagauaccgacaaccuccgccagguuguccaaaaccucccaggauccccagccaucaagaaaggaauccuccaaagcauaaaaauagucgacgagcuggucaaagugaugggacacgccccagaaucaaucgucaucgaaauggcucgcgagaaccaaacgacggcccguggcaagaaaaacucacaacagcgcuauaaacgaaucgaggacucacucaaaaaccuggcauccggguuagacagcaauauacuaaaagaaaaucccacggacaacauacagcuacagaacgaucgguuauuccuauacuaccuccagaacggaaaggacauguacacaggggaagcccucaacaucaaccaacucagcagcuacgacaucgaccacauaauaccccaggccuucaucaaagaugauucacuagacaaccgaguacugacaagcuccaaagacaacagaggcaagucagacaacguucccagucuugaagugguagagaagaugaaagcguucuggcagcagcuacucgacucuaaacucaucuccgaacgcaaauacaacaaccuaaccaaagcagagcgggagcgagguggccuaaacgaacuugauaaaguagguuuuaucaagcgccagcuugucgaaacccgacaaaucaccaagcacguugcgcagauccuggaugccagauucaacaaagaaguuaccgaaaagaauaagaaaaaccgcaacguaaaaauaaucacucugaaguccaacauggucagcaacuuccgcaaagaauuugggcuauauaaaguccgagagauaaacgacuaccaccacgcccacgacgccuaccucaaugcggucguugcuaaggccauacucaagaaauaccccaagcucgaaccagaguucgucuacggagacuaccagaaguacgaccucaagagauacauaucccgcucaaaagaccccaaggaggucgaaaaggcaacggaaaaguacuucuucuacuccaaccuccucaacuucuucaaagaagaggugcauuacgccgacggaacuaucguaaagagggagaacaucgaguacuccaaagauaccggugagaucgccuggaacaaagaaaaagauuucgcgaccaucaagaagguguuaucccuaccccaaguaaacaucgugaagaaaaccgaggaacagacggucgggcaaaacggaggccuguucgacaacaacaucguuuccaaaaagaaagugguggacgcaucaaaacucauaccaauaaagagcggacuuucccccgaaaaauacggcggauacgcccgaccaacaauagccuacuccguccuggucaccuacaaacaaaacaacaaaauuaagaacaccaugguagggauccccgugcuaacaaagcuagaguucgaacgcgacccuaaccucuaccuacgcaaccuaggaaucaacaacguuucccaugucaucaagcuagugaaauacacagugcuagaauuuaaacauaaauacggcaccuacagacgcuucaucgucagcaaucaagaacuuaaaagagccaaccaaauauucguaaccacaaagcagaugaagcugaucucccaauacaccacacuagacaagaacgagcacgacucacugcucaaaaacaaccaacagcucauccaaucuauauggaaccaauuccuagaguucaugcucgcaaccgaccuggugaacaaaaagcaauacgacgagcugauacucacgaacaaccaaacgaucgaagagugcagaaacaucaugaaccgcguuaucaccaccuuaucauucacaaauaucaacgcuggacagaaaaagaucauuuucgacgacacgcucucccucccaauaaaacgcuggcaauucaccgacagcgacaagauggucaaaaagaucaucgaauccacucucauccaccaauccaucacuggucucuacgagacaaggaucgaccucucuaagcugggugaagauuga

SEQ ID NO: 6668 - RNA, 4134 nt, Artificial Sequence
  Cas9 variant
auggaaucaaaccacgacggcgaacaaguaaaauacacacuaggacuagacaucggaacuucgucuauaggguacgccgcaauagacaaacaccaaaaaccaauacgcgccaaggggaaacacguaaucggaguacgacuauuucaagagggccaaaccgcugccgaucgacgcgccuuccgaaccacccggcgcagacuuaagcggagaaaauggcgucugaaccuucucaaccgucucuuugacccuuacuuguccgaaguagauccgaacuuccucccccgccugcgccaaagcaaccucuccccaaaagacgacaacaagcacuucaacggguccacccuguuuccggacaaaaccgacgccgccuuuuacaggcaauaccccaccauguaccaccuacgcuacgcacuaaugacugagaaacgaaaauuugacauccgagaaguuuaccuagcaauccaccacaucgucaaguacagaggcaacuuccuaaacagcgccaccguagacuccuucaagacaucuaacauagauuucacgagccaauuugaccgccucaacgaauuauaccggcaagugauccuagacgaacccuuccaaaucaacauggaucaggucgacgaaaugaccaacaaacuccucgacaacgacgcacucaaguuagacacacaaaagcaagucgccaaauugcuucccguaauauacaacgauaaacccauagacaagcaguacacacgcauugccaccgaguucuccaaagcaauccucggcuauaaaacgaaacucgacgucauauuaaacuuggacacacagaacgcgaaagacuggguaauccgacuugacgacgaagauauagacgacaaacuacccgcccuaguagaaaaccucgacgagucccggcaggaaauugucaccaucauacgagaucuuuacgcccaaaucacucugaacgcgaucgugcccaaaggcaagucucucuccgaaaguaugguagacaaguauaacgaccacaaagaccaccuugaccuccucaugggacuaauacaugagcuaggcgacgacucagcaaaggggaucaaacuccgggaagcguauacccaauauguagggaaaucagaugauaagacacugaaccaagacgacuucuacgccgccaucaagaaaaaccucgacgaggauagcaaacgcagcccaaaaauacagcgccugauugaacaagccagcuucaugccgaaacaacgaaccagcgccaacggaguuaucccacaucaacuccaccaauuagaauuagaccggauaaucgagaaccaggggcgguauuaucccuuccuaaagaaacccaaccccaacacucacaaacccaacggcggcaaauacaaacuagacgaacuggucgcauuccgaauccccuacuaugucggcccacuaaucaccaaacgcgaccaagagaaaacaucaggugccgacuucgcauggaugauaagaaaacccggacaggaaggcgaaauaacgccuuggaacuucgaccaaaaagucgacagaauggccucggcgaacagguucauccgaagaaugaccaccaaagacucuuaccucguagcagaagacguccuacccgaugccucccugaucuacgaaaaauuuaaagcccucaacgaacucaacaugcucaaagucaacgacagcaggcucucgcccucccagaagcaagaccuauucaauaaccucuuuaagaaacagaaaacaauccgcacgaagaaacuccaaacguauauccgcaccaacugggaacucccaucagugaugaucucggggcuagccgacccggacaaauucaacuccucacucagcacuuacaucgacuuuagagacauauuuggagaaaaaguagacgauccaaaccgucaagccgauuacgaagaaaucauagaguggucuacagucuuugaagaucguaaaauauaccaagccaaacucaaccaacucgacuggcugacugagccccaacgcaaagcauuacuaacaaaacgguacacgggauggggucgacuaaguaagaaacuccucaccggauugaaagaccagaauggggacucaauccuagaccaacucuggaaaacaaacgacaacuuuaugcagauccagucucgcgacgaguucgcaaaacagauacacgacgaaaacgccaaacaauuccacgaagcaaacaacgucgacgacauacuagaugacgccuucaccucaccccagaacaaaaaggcaaucagacaaguggacaaagucguccaggacgucguuaaagccgugggauacgcccccgacaaaauagccaucgaguucacccggucgcuagaaaacaacccccaacgaacggucagucggcaacgccaacuccaagcagcguacaaaaacauuccaagagaaaucaugaaaagcggucucauggccgaacuuggcuccguagccgacucgaagaagguccuauccgacaaacuauauuuauacuuuacccagauggggaaggacauguacgaagacaaaaccauaaacauugacaacuuaccaaacuacgacaucgaccacauuuugccccaagccuuuauaaaagacgauucgauagacaaucgcguccuaauaagcaaagaggaaaaugcucgaaaaucaaaccgagucccccucaaauucuucggcgccaagcgcaugggcuucuggaaagaccugcucaacaacggccuaaucucaaaccgaaaauuccaaaaccuaacuacagaccccgagaaaaucaguaaauacucagcgaagggguucauccaccgacagcucguggaaaccucccagguaauccggcuuguagccaacauccucggaaacgaguacucccaggcgggcaccacaaucaucgaaguaagugcaaaaaugaaccgacaauuacgcgaggacuuucaccuaaucaagaaucggaacgucaaugacuaucaccaugccauggacgccuaccuaacagcuuaugucggggacuaccuguaccugcgcuaccccaagcucaggccguacuucgucuacggagacuucaagaaggccgaagaccaggaccucaacaucagaaacuucaacuuccuccacgaccucaaagacaaugaaagccucgacaaaauagucgacagcgaaaccggggagauagucugggaaaaacacggcagcguaaagcaacucaagaaggucuaccacuauaaauucaugcuagugucccaagagguuuauacccgucaggacgcccucuucaaccagacaaucuaccccgccucagaugcugacaaacgcaaacuaauccccaucaaaaacucaaaacccgucgacguuuacggaggauauucaggcaauaucgaugcguacauggccaucgucagaguccacggaaagaaagaagacaacuacaaaguagucggaauccccaugagagcaguuaccaagcugaagaaagccgaaaaagaaggccacgacagcuaccucaacgcaguacacgaaguucuuaaaccacaauucacuaaaaagaagaaaaaccgaaaaacaggagagaucaccgaaaccgucgaugaguucgauguccugcucgguaagguauacuaccggcagcugauugucgauggaaacaaaaaguucaugcuaggaucuagcuccuaccaauacaacgccaaacaacucguccuauccgauaaggcaaugcaaguacucuccaagaauggaaaaguaaagucacaagacgaaaaccagaaccuuauagacguauaugacgaaauucuagaaaaaguagaucaauacuucgaacuguacgaccaaagacacuaccgggaaucccuccacaaaggccgcggcauauucgucaacuuaccccuuuccaaccaauacgauggauccaaacuaaccucauacggaaaguacgagaccaucgaugccauauuaaacggccugcacgcaaacgccaccaugagcaaccuacgauaccuuggcauaagcagccccuucggaaaaaugcaggcaagcaacgggcucaccauagauccagacagcauaaucugcuaccagucgcccaccggacuuuucgaacgucagaucaaacucagcgaucucuga

SEQ ID NO: 6669 - RNA, 4134 nt, Artificial Sequence
  Cas9 variant
augaauaagcccuacucaauuggccuggacauagguacgaacuccgucggcuggucuauaauuaccgacgacuacaaagugccagcaaagaaaaugcgcguacugggcaacaccgacaaagaauacaucaagaaaaaccuaaucggagcacuccuuuucgacgggggcaauaccgccgcagaccggaggcuaaagcgcacagcccggcgcagguacacucgaagacgcaaccguauccuguaucuccaggagaucuucgcugaggaaaugucuaaaguggacgacuccuuuuuccaccgccuggaggacagcuuccuaguugaagaagacaagagaggcaguaaauaccccauuuucgccacgaugcaggaagaaaaauacuaccacgaaaaauucccaacgauauaccaucugagaaaggaacuagccgacaagaaagagaaagccgaccugcgucuuguguaccucgcacucgcacauaucaucaaauucagaggccacuuccuaaucgaagaugaccgauucgacguacgaaacaccgacauacaaaagcaguaccaggccuuccuggaaaucuucgauacgacauucgagaacaaccaucugcuaucccagaacguggauguagaggcgauucucaccgauaagauaagcaaaagcgcgaagaaagaccgcauacuagcccaauacccaaaccagaaaagcacuggcaucuucgcggaguuccucaaacucaucguuggcaaccaagccgacuucaagaaacacuucaaccuagaagacaaaacacccuugcaauuugcuaaagauucauacgacgaagaccucgagaaccugcucgggcaaauuggagacgaguuugcggaccucuucagcguggccaagaaacuuuacgacagcguauuguuauccggcaucuuaacggucaccgaccuaucaaccaaagcgccccucuccgccucuaugauccaacgcuaugacgaacaccacgaggaccucaagcaccucaagcaguucgucaaagccagccuccccgaaaacuaccgcgagguauucgcggacuccagcaaggacggcuaugcaggcuacauagaagggaaaaccaaccaagaggccuucuacaaauaccuucuaaagcuccugaccaaacaagagggguccgaguacuuccuugagaaaaucaaaaacgaagacuuccuccgcaagcaacgcacauucgacaacgggucaauaccucaccaaguccaccucaccgaauuacgggcaaucauccggcgucaaucagaauauuacccauuucuaaaagagaaccaagaccggaucgaaaagauccuaacauuucgaauaccauacuacgucggcccacucgcucgcgaaaaaucggacuucgccuggaugacucgcaaaacagaugauagcauacgcccguggaacuucgaagaccuagucgacaaagagaagagugccgaagccuucauacaccgcaugacaaacaacgaccucuaucuaccugaagaaaaaguacuacccaaacacuccuugauauacgaaaaguucaccguguacaaugaacucacaaaggucagguuccuagcggaaggauuuaaagacuuccaauuccucaaccgcaaacaaaaagagacgaucuucaacuccuuauucaaggagaagcgcaaggucacagaaaaggacaucauaucguuccuaaacaagguggauggcuaugaaggcaucgcuauuaaaggcauagaaaaacaguucaacgccucgcuauccaccuaucacgaccucaaaaagauacucggcaaggacuuccuagacaacacagacaacgagcuaauccuggaagacaucgugcagacacucacccuauucgaagacagagaaaugauaaagaaaugccuagacauauacaaagacuucuucacagagucacaacucaagaaacucuaccgccgccacuauaccggauggggccgccuuuccgcuaaacuuaucaacggaauuaggaacaaagaaaaucagaaaacaauacuggacuaccucauugacgacggcagcgccaaccgcaacuucaugcaacucaucaacgacgacgaccucuccuucaaacccauuauagacaaagcccgcacgggcagccauucugacaaccucaaagagguggucggcgagcucgcaggcucaccagcaaucaaaaaggggauacuacaaagccugaagauagucgacgaauuagucaaggucaugggcuacgaaccggaacaaauagugguugaaauggcacgagaaaaucaaaccacggcuaaaggccuaucacggucaagacagcgcuugaccacacuacgcgagucccuggcaaaccugaaaucaaacauccucgaagaaaagaaacccaaauacguaaaagaccaagucgagaaucaccaccucuccgacgacaggcuguuccucuacuaccuccagaacggacgggacauguacacgaagaaagcgcuagacaucgacaaccucagccaauacgacauugaccacaucauuccacaagcauucaucaaagacgacucgauagacaaccggguacuugucuccuccgccaaaaaccgaggcaaaagcgacgacguccccuccauugagaucgucaaggcgcguaaaauguuuuggaagaaucugcucgacgccaaacucaugagccaacgcaaguacgacaaccuaacaaaagccgagcguggaggacuuacuuccgacgacaaagcccgcuuuauccaacgccaacucguagaaacgcgccaaauaacaaaacaugucgcacgcauccuugacgagcgguucaacaacgaaguagacaacgguaagaaaauaugcaaaguaaaaauaguuacacucaaauccaaccucgugucuaacuuucgcaaagaguucggauucuacaaaauccgcgaagucaaugacuaccaccacgcccacgacgcguaccuuaacgccgucgucgcgaaagccauacucacaaaauacccccagcucgaacccgaauuugucuacggcauguaccgccaaaagaaacucagcaaaauaguucaugaagacaaagaagaaaaauacuccgaagccacccgaaaaauguucuucuacuccaaccucaugaacauguucaaaagagucgugcgccuagcggacggcuccaucguaguccggccugucaucgaaaccggacgauacaugcgcaaaacagcgugggacaaaaagaaacauuucgcuacaguccgcaaagugcucuccuacccccaaaacaacauagucaaaaagacugaaauacaaacagggggauucagcaaggaaucaauacuugcucacggaaacucggacaaacuuauaccgcgcaaaacgaaggacauauaccucgauccaaagaaauaugggggcuucgacucuccgaucguggccuacucuguccucgucguggccgacaucaagaaaggcaaagcccaaaaacuaaaaacgguaacagaacuucucggaauaaccaucauggaacgcagcagauuugagaaaaaccccagugcauuccuugaaaguaaaggauaccuuaauauccgcgacgacaaacucaugauacuacccaaauacucccuauucgaacucgagaacgggagacgacgccuuuuagccagcgccggugaacuacaaaaaggcaacgaauuagcucugccgacccaauucaugaaauuccuuuaucucgcgucucgauacaacgaauccaaaggaaaaccugaggagaucgaaaagaaacaagaguuugucaaccaacacguguccuacuucgacgacauucuccaacucaucaacgauuucucaaaacgugucauacucgcugacgccaaccucgagaaaaucaauaaacuguaccaagacaacaaagaaaacauccccguggacgaguuagcaaacaacaucaucaaccuauucacuuuuacgagccucggggcacccgccgcauucaaguucuucgacaaaaucgucgaccgaaaaagguauaccucgacaaaggaaguccucaauuccacacuaauacaccaauccauuaccggccucuacgaaacacgcaucgaccucggcaagcucggugaggacuga

SEQ ID NO: 6670 - RNA, 4134 nt, Artificial Sequence
  Cas9 variant
auggagaaaaccuacuccauaggacucgauauaggaaccaacucaguaggcugggcggugaucaccgaugacuacaaagucccagcaaagaaaaugaagguacucggcaauaccgacaagaaauacauuaagaagaaccuacucggcgcccucuuauucgacucgggggagacggccgaagccacucggcugaagcgagccgcacgccgacgcuauacaagacgcaaaaaucgacugcgauaccuacaagagaucuucgccaaggaaauggcgaaaguggacgagagcuucuuccaaaggcucgaagagagcuuucugaccgacgacgauaagaccuucgacucacaccccauuuucggcaacaaagccgaagaagacacauaccaucaggaguuccccacaaucuaucacuuacgaaaacaccuagcagacucaccagaaaaaguagaccugcgguuagucuaccucgcacucgcacauaugaucaaauuccgugggcacuuccucauagaaggccaacuaaacgccgaaaauaccgacguccagaaaauauucgccgacuuugucggagucuacgaccguacuuucgacgauagccaccuaucggagaucacagucgacgccgcgagcauacugacagagaagauauccaagagccgucgacucgaaaacuuaaucaaacaauauccaaccgagaagaaaaacacacucuucggaaaucucgucgcacuagcgcuuggacuccaaccaaacuucaagaccaauuucaaauugagugaggacgccaaacuacaauucucaaaagacaccuacgaugaagaccuggaggaacuacucggaaagauaggcgacgacuacgccgaccucuucacagccgccaaaaaccucuacgacgccauccuccucuccggaauccuaacuguggacgauaacucaaccaaagccccacucucggccucuaugaucaagcgcuacgaagaacaccacgaagaucuggagaaacucaaaaccuucauuaaaguaaacaacuuugauaaguaccaugaaaucuucaaagacaagucuaagaacggauacgccggauacauugaaaauggcguaaaacaggacaucuuuuacaaacaccugaagucgauuauaagcgagaaaaacggcggccaauacuuccuagacaaaaucgaacgcgaagauuuccucaggaaacaacggacauucgacaacgguaguauccccuaccaaauacaccuccaggagaugcguacgauacugcggcgccaaggggaauacuaccccuuccugaaggaaaaccaggccaagaucgagaaaauucucacauuccggauacccuacuacgucggcccccuagcccggaaaaacucccgcuucgccugggccaaguaccauuccgacgagccaauaaccccguggaauuucgaugaaguggucgacaaagagaaaagcgccgaaaaauucauaacacgcaugacacucaacgaccuguaccuccccgaagaaaaaguacucccaaagcauuccuaugucuaugaaacauucgccguguacaacgaacugaccaaaaucaaguacguaaacgaacaggguaaaucguucuucuucgacgccaacaugaaacaggagauauucgaucacgucuucaaagagaaccggaaagugaccaaagcgaaacuccuauccuaucucaauaaugaauuugaagaguuccgaaucaacgauuuaaucggccuggauaaagacaguaaauccuucaacgccagcuugggcacuuaccacgaucucaagaaaauacuagauaagagcuuucuagacgacaaaaccaacgaacagaucauagaagacauaguccugacccucacgcuuuucgaagaccgggacaugauccacgagcgacuccagaaauacagcgacaucuuuacaucccagcaacucaagaaacuggaacgacgucacuacacaggguggggacgauugucguacaaacucaucaauggaauacggaauaaagagaacaacaaaaccaucuuggacuuccucaucgacgauggggacgccaaccgcaacuucaugcaacucauaaacgacgacucccuuuccuucaaaacgacgauccaagaggcucagguggucggcgacguagacgacauugaagcgguaguacacgaccucccaggguccccugccaucaaaaagggcauacugcagucugucaaaauagucgacgagcuggucaaagucaugggccacaacccccagaacaucgugauugaaauggcccgcgaaaaccaaauuaccggauacggacgaaacagaucgaaccagcggcucaagcgccuacaagacagccuuaaggaguucggaagugacauacuuagcaaaaagaaacccucguauguagacagcaaagucgaaaacucacaucuccagaacgaccggcuauuccuguacuacauccaaaacggcaaagauauguacacgggggaagaacuagacauagaucaccugucagacuacgauaucgaccacauuaucccgcaggcuuucauaaaggacaacucaauagacaaccgcguucuuaccucaucggcuaaaaaccgggguaaguccgacgauguccccucgauagagauaguaagaaaccgaaagagcuacugguacaaacuauacaaaucagggcugaucagcaaaaggaaauucgacaaccucacaaaagccgaacggggaggacucaccgaaacugacaaggcgggauuuauaaagagacaacuugucgagacccgucaaaucacgaaacacgucgcucaaauccuagacgcacguuucaacaccaaaugcgacgaaaaugacaagguaauaagggacgucaaggucaucacgcugaaguccucgcuugugucccaauucaggaaagaguucaaguucuacaaaguccgggaaaucaacgacuaccaccacgcccacgaugcguaccuaaacgccguaguggguacggcgcuucucaagaaauacccaaaacuagcgccugaauuuguauauggggaauacaagaaauacgacguccgaaagcuagucgcuaaauccagcgacaaccacagugaacuuggcaaagcaaccgccaaauacuucuuuuacuccaaccugaugaacuucuucaaaaccgaagucaaauaugcagauggccgagucuucgaacgacccgacauugaaaccaacgcggacggugaaguaguauggaacaaacaacgggacuucaacaucguacgcaagguccucagcuacccccaagugaacaucgucaaaaaggucgaaguacaaacaggaggauucucgaaggagucaauacuacccaagggcgacucggacaagcucaucccccggaaaacaaagaaacuccagugggaaacacaaaaguacgguggauucgacuccccaacagucgcguacagcguccucguaguagccgacguagaaaaaggcaagaccagaaaacuaaaaacuguaaaagaacuggucggcauuuccauaauggaacguuccagcuucgaggaaaacccagucagcuuccuggaaaagaaaggauaccacaacguacaggaggacaaacucauuaagcugccaaaauacagccuguucgaguucgaaggcgggcgacggcgucuccuagcgucagccacugagcugcaaaagggaaacgagguaguacuaccccaauacauggucaaccuccucuaccacagccaacacguuaacaacagccauaaacccgaacaccuaaacuacguuaagcaacacaaagacgaguucaaggacauuuuuaaccucaucaucaguauagccagaaucaacauacugaaaccgaaagugguagauaaucucauaaacgaguucaccgaauacggucaggaagacauaucuagccugucagaaucauucaucaaucugcucaaauucaucuccuuuggagcuccuggagcuuucaaguuccuaaaacuugacgugaaacaguccaaccuccgcuacaagagcacaaccgaagcacuguccgccacacuuauucaccaaagcguaacaggucuauacgaaacacgaaucgaccuaagcaaacuaggcgaggaauga

SEQ ID NO: 6671 - RNA, 4137 nt, Artificial Sequence
  Cas9 variant
augaaaacuuucgccgaggaguacguaauggauaaaucaaaacccuacggcauaggacuggauaucggcaccaauucagucggcuucguugcaacagacgcagaaggacaccuaauacgccucaagggaaagaccguaauaggcgcauaccuguucaacgccgguaucagcgccgcagagcgaagaggauuccguacaacacgaaggcgacucucaagggucaaauggcgacuuggacuccugcgagagauauucgaaacccacuuccaggagucgaugggugagaaugaagacaacgacuuuuuccuccgauucaaguacucgaauauaucaccaaaagauccgcaguuuuccacagcaaagggccuauucaacgaccgcaccgauaaagaguuuuacgaucaauacccaaccaucuaccaucuacgacgcgccuuaaugacugaggaccaucaauucgacauacgggaaaucuacauagcaaugcaccacauagucaaguaccgcgggcacuuucucaaagaaggccgagccaaagacuucaaggucggagaucuccgccuccuggacaacuucaagaugaugaacgagcaaauagaagaaauaaacccccuauggcaacuaaaacuaccaaccgacgacgcgagcaucaaauccauaacagcaauacuccucgacaacacccaaagucaaaacgacaggcagaaagcaguaacuaaagugauucucgcgacccucguuaaggccucagacaaagauaucaacgccgcacgcaaacgcuuuguaggcgaacucaguaaggcgauggucgggcugaagacuaagcuaugggugcuugcagacgucucccagaacggcgacugggaaauaaaauacgaaaacuaugcggacuucgccgagacaauuggcagcggcgaaagcgauacaauccaaagucuuuucaacgaaauuaacgaccuauacggugucaucacgcucgccggaauaauacccaaagaagcggaaucauucagcgacggaauggugcgaaaauacgaacaccaucggaaaaaucuagaacuccucaagguauacugugcagaacagagcgacggcaaaagagggcgccaaaucagacaaaccuaugacaaguacauagacgggguagacagcaagcaauucacucaagaagacuucuacaaggcccugagcaaguucacggccaaggaugaagcaaccuccgagaacgccaaacuuaucgcccaggaaaucgccgucggcacguucaugccaaagcuccggacaaaggcaaacggcaccauaccacaccagcugcaccaaaaagagcuugacgcgaucauagaaaaucagaagaaauacuaccccugguugggcgaagucaauccaguggagucccaccgacgcgcccuuccauacaaacuagaugaacucgucuccuucagaauccccuacuacgucggcccgauggugacccccacgaaaggagacccugagaaaagcaaauucgccuggaugguuagaaaagaaccagggaccaucacccccuggaacuucgaucaaaaggucgaucgcuccgcgucaggagaagccuuuauucagcgcaugaaaacgacagacaccuuccuuauuggagaagacguccuaccgcagcaaagucuucuguaucaaaaguucgagguacugaacgaacuaaacaagaucaugaucaacggcaaaccaaucugcagggaacagaaacaaagacucuucaaacaacuuuucaugcaauacaaaacagucacggugaagaaaguucagcaaaaccucaucgcaaacggagaagagagcgaaaacgucccuaucaccggccucucugacccccucagauucaacucauccuucagcacauacauagauuauaaagacauccuaggcacagcagcaguaaacgacaacgccaaacaauccgauauugaacaaauaaucgccuggagcacaauauucgaagacgccgccaucuuccgcgaaaaacugaacgacauaacauggcugaacgacgaccagcgaaauaaacuuucgcacaaacgauacagaggauggggcagacacucccgaaaacuccuagcgggacuccgggacggcgaagggcaaaccaucauagaacgucuuuggaacaccaacgacaacuucaugcaaauacagaaugacuccgagauugcacgccaaaucacagaggccaacagcagcaaaauggcaaccgcagagggcacagacgaaauaauugacggcuuuuacacaucccccgagaauaagaaagcucuacgagaagucaugaaaguagucaaagacauccagagagcacaccacggccaagccccggccugggucuacaucgaguccccacgggagacaccccggccgggccaacgcaccgucuccagagagcagcaacuaaccgacuuauacgagggagcggcaaaagagauagucgacgacgcaguccucaacgaacuuaaagauaaaguaaaaagcaaagagaacuucacugacaagcuaguccucuacuuccuccagaacggccacgacaucuacgccaacgacucaauaaacaucgacaaccuaaacgccuacgacauagaucacgugcucccccaaucgcuaauaaaggacgacucacuagacaaucgcguccucaccacccacgaacggaaccucaaaaaguccaaccgcuucgcaacagaacuauucgccgaccaacguaagaaaugggaaaaauggcacaggcucgggcucaucucaucccgaaaacuaaaacaccuaaccaugcaaccaaacucggucgagaaauucgcacacggauuuaucgcaagacagcucacagaaaccaggcaaauaauccaccucacugcaaacgugcucucaaaccucuaccaagagaacgacaccaaaaucgucaugaucaaagccgggcucaauagcgaguuccgacgaacauucgacuucccgaagaacagaucaguaaacgacuaccaccaugcauucgacgcauuucucaccgccaaaaucggucguuaccuccuugcucgguaccccaaacuugaacccuucuuugucuacggcaacuuugugaaaaacccgaaggcaaugaaaagacucuccagcuucgacuucauagcccaacuagccgcaaaaaccgacgauaccucccauaucgaccaacgcucgcuaaaacagguaccagugguaaacgaagaaacaggcgaaauuguuugggacaaagauaucgaacuagcagagcucgacaagacauauaauuauaaaaccaugcuagucaagcgagcacaaaccgaaaacaaugcccaaauguucaagcaaacggucuucaaagcccgagacaaccaaaacaaaacgcucauaccagucaaaaacggguuauccacagacgucuacggcggccauagccaacaagccauuucauaucugugcauaguauggguaggccaaaagaagaaauaccgaguccucgguauaucaaccgcccacgccgggauucugaacaacuucgagaaaaacuacggucgguucgaagcgaaaaagaaacuacaagaaaucgugucgaacacgcucgacaacgcagaccgcaaugacuucaagaucgucgcacccaaaguacucuucgaacaagucguggaagacgacaacaugaaauucggccuaggaucggccagcgacuaccgaaauguccaacaacucuuccuaagucgcaaaaaccaacuccugcucgcaaacaugaugaccgaccaaauacacgaccaggaccucguccaccuauucgacgaaauugugggccagaugaacgcacauuucccgauauuugaccgcggcggguaccgcagcagcuugacacagucgcgcgacaaguuccucaaacuuccguuuaagaagaacgaagaccuuauaaccaaacaggagguuauuagacgcauacuagacggccuccaugccaacgccaaccguaaggaucuaaagauaaucggcuccaagggcgauuucggccgacucggcaccaagaagaucuaccuguccaaggacgccaaacucaucuauacaaguccgaccugccuguucacgagaacgguuccccucuccucucucuga

SEQ ID NO: 6672 - RNA, 4137 nt, Artificial Sequence
  Cas9 variant
augaccaacgaaaaauacucgaucggccuagacaucggcacgucuagcauaggcuucgcagucguaaacgacaauaacagagucaucagggugaaaggcaaaaacgccauaggcguccgacuauuugacgaaggcaaggccgcugccgaccggcgauccuucagaaccaccagaagacgccugucccgcaggcgauggcgccucaaacugcugagggaaaucuuugacgcguacaucacccccgucgacgaggcguucuucaucaggcuaaaagagagcaaucucuccccaaaggauagcaagaaacaauauucgggggacauucuguucaacgaccgaagcgacaaagauuucuacgagaaguacccaaccauauaucaucugagaaacgcacuaaugacagaacaccgcaaauuugacguccgcgagauauaccuggcgauacaccacauuaugaaauuccgcggccacuuccugaacgcgacgcccgcaaauaauuucaaaguggggcgacuuaaucucgaggagaaauucgaagaacucaacgacauauaccaacgcgucuuccccgacgaaucuauagaguucagaaccgacaaccucgaacaaauaaaagaaguccuacuagauaacaaacggucccgagcagacaggcaacgcacacuugucagcgacaucuaccagucguccgaggacaaggacaucgagaaacgaaauaaggccguagccacagaaauccucaaagcaucccucggaaacaaggcuaagcucaaugucauuacaaacguugaaguugacaaagaggcggccaaggaaugguccauaaccuucgacucagaauccaucgaugacgaccuagccaaaauagagggacaaaugaccgacgacggccacgaaaucaucgaaguguuacgcucguuauacagcggcaucacacuauccgcaaucguuccagaaaaccacacucucucccagaguaugguagcaaaauacgaccuccauaaagaccaccugaaacucuucaaaaagcucaucaaugggaugacagacacgaagaaagcgaaaaaccuacgggcagccuaugacggauacauugacggugucaaaggcaaaguccuaccccaagaggacuucuauaagcagguccaagucaaccucgacgacuccgccgaggcuaacgaaauacagacauacaucgaccaagacaucuucaugccgaagcaacgcacgaaggcuaacggaucaauaccacaccagcuucaacaacaagaacuagaucagauaauagaaaaccaaaaggccuacuauccauggcuugcagagcuaaauccaaaccccgacaagaagcggcaacagcucgcaaaauauaaacuagacgaacuugucacguuccgcguccccuacuacgucgggcccaugaucacggcuaaagaccaaaagaaccaguccggggcggaguucgccuggaugauccgcaaggaacccggaaacauaacaccauggaauuucgaucagaaaguagauaggauggccacagccaaucaguucaucaaacgcaugacuacaacagacacauaccuacugggagaggacguacucccagcucagucgcuccuguaccaaaaauucgaagugcugaacgaguugaacaagauacggaucgaccacaaacccaucuccaucgagcaaaagcaacaaauauucaacgaccuauucaaacaauucaaaaacguaacaaucaaacacuuacaagacuaucuaguuucccaaggacaauauuccaagcguccuuuaaucgagggccucgccgacgagaagcgcuucaacucaucccuaaguacauacucggaccucugcggcaucuucggcgcgaaacuugucgaagaaaacgaucgccaagaggaccucgagaaaaucaucgaaugguccacgaucuucgaagacaagaaaauauaccgcgcgaaacuaaacgaccuaaccuggcuaacagacgaccaaaaagaaaaacucgccaccaagcgauaccaaggguggggccgacuaagccgcaaacuacucgugggacucaaaaacucggaacaccgcaacaucauggacauacuauggaucacuaacgaaaauuucaugcaaauacaggccgaaccagacuuugcaaaacucgucaccgacgccaacaagggcaugcucgagaaaaccgacucccaagacgugauaaacgaccuguauacaucuccccaaaauaagaaagccauacgccaaauccuccucgucguccacgacauccaaaacgccaugcacggccaagccccagcuaaaauccacgucgaguucgcccgaggggaagaacgaaauccucggcgcucaguccaaagacaaagacaaguagaggccgccuacgagaaagucuccaacgaacugguuuccgcaaagguccgccaagaauuuaaagaagcaaucaauaauaaacgcgacuucaaagaccgccuacuccucuacuucaugcaagggggcaucgacaucuacacggguaagcaacuaaacaucgaucagcuuucguccuaccaaaucgaccacauccucccccaggccuucgucaaagaugacucgcuaaccaacagaguacuuacaaacgaaaaccaagugaaagcggacucaguaccaauagauaucuucggcaagaaaaugcuaagcguguggggcagaaugaaggaccaaggacuaauauccaagggcaaguaccgaaaccucacgaugaacccagaaaacaucucagcccacacggaaaacgguuucaucaaccgccagcuaguggagacacggcaagugaucaagcucgccgugaacauauuagccgacgaauacggcgacucuacacaaaucaucagugucaaggcggaccuaucucaccaaaugagagaggacuucgaacuccucaaaaacagagauguuaaugacuaccaccacgcguucgacgcguaccuagcggccuuuaucggcaacuaucuccucaaacgauacccaaaacuagaaucuuacuucgucuacggggacuuuaagaaauucacgcagaaagagaccaaaaugcgacgauucaauuucauauaugaucucaaacauugcgaccaagucgucaacaaagaaacaggcgagauucuauggacaaaagacgaagacaucaaauacauacgacaccucuuugcauacaagaaaauacucguaucacacgaaguccgcgagaaaagaggagcccucuacaaucaaacgaucuacaaagcaaaagacgauaaggggagcggacaaggcuccaagaaacucauacgaauaaaagaugacaaagaaacaaaaauauacgguggcuauuccggaaaaucccuggcguauaugacgauagugcaaauaacgaagaaaaacaaagucucguaccgagugauuggcauaccaacucucgcccuagcccgccucaacaaacuggaaaaugacucuacggaaaauaacggagaacuguacaaaauaauaaagccgcaauuuacacacuacaagguagauaagaagaacggagaaaucauugagaccacagacgauuucaagaucguggucagcaaaguccgcuuccagcaacucaucgacgacgcaggccaauucuucaugcucgccagcgacaccuacaagaacaaugcgcaacagcucguaaucucaaacaacgcacucaaagcuauaaacaauacaaacaucacagacuguccucgagacgaucuugaacgccuggacaaccuacgccuagacucagcauucgacgaaaucgugaagaaaauggacaaauauuuuagcgcguacgacgcaaacaacuucagggagaaaauacgaaacucgaaccugauuuucuaucaacucccaguugaagaucaaugggaaaauaacaaaaucaccgaacucggaaagcgaacgguccucacccgcauccuacaaggccuccacgcaaaugcaaccaccaccgacaugucaaucuuuaaaaucaaaacacccuucggccaacugagacagcgauccggcauaucacucuccgaaaacgcucagcucauauaccagagcccaaccggacuuuucgaacgacgcguccaacuaaacaaaaucaaguga

SEQ ID NO: 6673 - RNA, 4137 nt, Artificial Sequence
  Cas9 variant
augaagaacaaggacuauaguaucgggcuggacauaggaacuucauccauaggcuucgcagucgucgacgaaaacaaccacgugaugcgcgugaagggcaaaaaugcaaucggcguccgucuauucgacgaaggaaaacccgcagcagaccggcgagcguucagaaccacacgccgccgccucucgcgcagaagauggcgacuaaagcuacucagagagauauucgacagcuacauuacacccguagacgaggccuucuucauccgccuaaaagaaucgaaucucucacccaaggacuccaagaaacaauauucaggagacauccucuucaaugaccgauccgacaaggacuucuacacaaaauacccgaccaucuaccaucugcggaacgcacuaaugacggaacaccagagguucgacauaagagaaauauaccucgcgauccaccacaucguaaaauuccggggacacuuucuuaacgcaacuccagccaacaacuuccaagucgggaaacuugaccuagaucagaaguucgaggaccucaacgacaucuaccaacgaguauuuccggacgacucaaucgaguucagaauagacaaccucgaacagauaaaagccgugcuucuagauuccaaacggucaagauccgaccgccagcgaagccucgucgacgacguauaccaaacaagcgaagacaaagaagucgaaaagcaaaacaaggccgucgcaacagaaguccucaaagcgauacucggcaacaaggcaaaacucaacauaauagccaacguagaggucgacaaggaggcagcaaaagaauggacaaucacguucgauuccgaaagcauugacgacgacuuagccaaaauugacgggcaaaugacagacgacggcagagcgauagucgaaauacugcgaucccuguacagcggaaucacccucucggccaucguaccggaaaaccacacccucucacaggcuauggucgccaaauacgacuuacacaaaaagcaccucacacuacucaagaaacuaauuaacagcaugacggacacaaagaaagccaaaaaccucagagccgcauacgacggauacguagacggcguaaaggguaaaguccucacucaagaugaauuuuacaaacaaauacaaucaaaccuggacgaguccgucgaagccuccgaaauacagaccuacaucgaccaagacauauucaugccuaaacaacgcacaaaagccaacggauccauaccccaccagcuccagcaacaggagcuagaccagaucauagagaaccaaaaggaguacuacccauggcuagcugaacucaacccaaacccagacaagaaacgacaacagcuagcgaaauacaaacucgacgaauuggucacuuuccgcguaccauacuacgugggccccaugaucaccgcugaagcgcagaaaaagcaaucaggggcggaguucgccuggaugauccgcaaagagucaggcaacaucacaccguggaacuuugaccaaaagguggacagaauggccacggcuaaccaauucauaaaacgcaugacaaccaccgacaccuaccuacuaggcgaggacguacuccccucccaauccuugcuguaccaaagauucgagguccuaaaugaacugaacaagauucgcaucgaccgcaaaccgaucagcguagagcucaaacaacaaaucuucaacgaccuguucaaaaaguucaagaacguaacuauuaagcaccuacaagacuaucuuguagcccaaggccaauacucaaagcguccacuaauagaaggccuugccgacgagaaacgcuuuaacucgggccuuagcacguacaacgacuucugcgguauauucggugcgaaacuuguggaugagaaugacagacaagccgaucucgagaaaauaaucgaauggucuacaaucuucgaagauaagaaaauauaccgagcgaagcuaaacgaccucgccuggcucaccgacgaacaaaaggacaaacucgccacaaagagguaccaaggcuggggccgacuaucguccaaacugcugaucggacuacaaaauucggagcaccgaaacauaauggaccuccuauggaucggcaacgaaaacuucaugcagauccaagccgacagugauuucgcgaagcucauaaaggacgccaaccagaaugcccuccaaaacaacgacucacaagacgugauaaacgaccuauacaccagcccacagaacaagaaagccauccgccaaauccuucuagugguacacgacauacaaaaugccaugcacggacaggcccccacgaaaauccacguggaguucgccaagggcgaagaacgcaacccccgccgcuccguccaacgacaacgacagguagaagccgcuuacgagaaggcaagcaaugaacucgugggcgcgaacgugcgggaggagcuaaaagacgccaucaccaauaaaagagacuucaaagaccgacuguuucucuacuucaugcagggaggcgucgacauguacuccggcgagccaauaaacauagacaaccuaucgcgcuacgauauugaccacauacugccgcaagccuucguaaaggaugacucccucaacaaccgcguacuaaccgacgcugaaaagaacaggcgaaaaagugacgccguccccaacgaauuauucggggccaagaugcgcgucaccugggagcgcaugaaggaacaaggacuaaucucuaaagguaaguaccgcaaccuuacuaugaaccccgagaacaucaauaaauacaccgagaacgguuucauaaacagacagcuggucgaaacacgccaaguaaucaaacucgcuguuaacauauuagccgaugaguacaaagagaacacucaaaucauaucaguuaaggccgacuuaucccaccagaugcgcgaagacuucgaacuccucaaaaaccgagacgugaacgacuaccaccacgcguucgacgcguaccucgcggcauucauggggaauuaccuccuuaagcgcuacccaaaguugcggagcuacuucguauacggcgacuucaagaaauucacccaaaaggaaauaaaacugagacgauucaacuucauauaugaccucaaacacgaggaccaggucauugauaaggagacuggagaaauccucuggaacaaaaaugaagacaucgcauacauuagacaccuauucgcguacaagaaaauacugauaagccaugaggugagcgagcgccgaggggcccuauacaaccagaccguauacaaagcaucagacgacaaagccagcggccaaggaucaaagaaacuaauaccaauaaaaucugacaaaccaaccgagaucuacggaggauacaccggacggaccuuagccuacaugacaaucguaaaagugacgaaagggaagaaaauaucauacaaagucgucggcgugccaacggcuguccuugcaaaaauggcuggaguacggcaaggcagccaagaggaacaggacaaacucuacggaguacuaaaaccacaauucacccaccagaaagaaaacaaaaagacgggagaaauaaccgaaaccguugacaaauucgacauaauuguacccaaagucaaguaccaacaauuagucaacgacaacgggcaacuauucaugaucgggagugacacacugcccuacaacgcagaacagcugguacucagcaaagaaaguguccaaacgaucaacaacccaggaauuaaggacgaaggcucagaugaggaauccgaaaauaagaaacuggacaacguguaugaugagauuguccucuguaugaacaaauauuucccacuauacgacaauaggggauuucgcaacaguaucacgaacggcaaaaacaaauuccuaaaacugccaaucaaaaacauauacaaaaacggaaagcuaaucaacgugggcaaacgggaggucaucaaccgaauccuccaaggcuuacacgccaacgcguccguaacggaccucucaaaccucggcauaaagagcccguucggcuuccuacagaaaggagccggacuaagccuaagcggugaggcccagcucauccaccaaagcgccacaggccucuucgaacaccgaguccaacucaacaaaaucaaauga

SEQ ID NO: 6674 - RNA, 4137 nt, Artificial Sequence
  Cas9 variant
augucgaacaaacccuauucaaucggccuugacauaggaacgaacagcgucgggugggcagucauaaccgacgacuacaaagucccgucaaagaaaaugaaagucuuagggaacaccgacaaacacuucauaaagaaaaaccuaauaggagcccugcuguucgacgagggcacgaccgccgaaggccgacggcuuaaacggaccgcccgccgacgcuacacacgccgcaaaaacagacucagauaucuccaagagaucuucagcgaggaaauuagcaaaguugacucgucguucuuucaccgccuggacgacuccuuccuugucccggaagacaaacgcgguuccaaauaccccaucuucgcaacgcuagcugaagagaaggaauaccacaaaaacuucccaaccaucuaccaccucaggaaacaacuggccgacucaaaagagaaagcagaccuccgacucauauaccuugcccuagcgcacaugaugaaguaccgcgggcacuuccuguacgaggaaaguuucgacauuaagaacaaugacauccagaaaaucuucaacgaguucauaucgauauacgacaacacauucgagggcagcucccucucagaacaaaacguacaaguggaagccauuuucaccgacaagaucucaaaaucugccaagcgagaaagagugcuuaagcuguuccccgaugagaaaaguacgggccucuuuucggaguuccucaagcucaucguaggcaaccaagcugaauuuaagaaacacuucgaccucgaagaaaaagcccccuugcaguucagcaaagacacuuacgacgaagaucuagaaaaccuccucggacagauaggggauggauucgccgaucuauuccuugucgcuaagaaacuuuacgacgcgauccuucuauccggcauccugaccgucaccgaccccaguacaaaagcuccccucucagccucaaugaucgaacgauacgaaaaccaucaaaaagaccuagcgagucugaagcaauucauaaagaauaaccugcccgcggaaaaaugcguggagguauucuccgaccaaagcaaagacggguacgcgggcuacauagacgggaaaaccacgcaggaagccuucuacaaauacauuaaaaaccuccuaagcaaacuugaaggcgccuacuacuuccucgauaagaucgaacgcgaggacuuccuccgaaaacaaaggacauucgacaacggcuccauaccucaccaaauacaccuccaagaaaugaacgcgauccuacgacgccagggcgagcacuacccuuucuuaaaggaaaaccgugagaaaaucgagaaaauacuaaccuucagaauacccuaccacguggggccccuggcgcgcggaaacagggacuuugcauggcucacccgaaacucagacgaagccauccgcccauggaauuucgaagaaauaguagaccaggcaagcuccgccgaagacuucaucaacaaaaugaccaacuacgaccucuaucuccccgaagaaaaaguccuucccaaacacucacuacucuacgagacauucgccguauacaacgaacugaccaaagucaaguuuauagccgaaggacuuacaagauaccaauucuuagacaagaaacaaaagaaagacauauucuacaccuucuucaaagcggaggacaagcgcaaagucaccgagaaagacauaauccacuaucuacacaacguggacggauaugacggcauugaacugaaggggauagagaaacaauucaacgccagccuaucuaccuaccacgaccugcuaaaaaucauuaaagacaaagaguucauggacgauccuaaaaacgaagaaauucucgagaauaucguacacacacuaacgaucuucgaagaccgugagaugauaaagcaaagacucgcccaguacgauucccucuucgacgagaaaguaaucaaagccuuaacaaggcgccacuacacaggcugggggaaacucucagcaaaacucaucaacggcaucugcgacaaacaaacagggaaaacuauccuagacuaccuaaucgacgacgggaaaauuaaucgaaauuucaugcaacucauaaacgacgacggacucuccuucaaggaaauaauccagaaggcacagguggucggcaaaacauacgacgucaagcaagugguacaagagcuaccuggaagucccgcgaucaaaaagggcauacuucaaagcgugaagcucgucgacgagcucguaaaagucauggggcacgccccagaaucgaucguaaucgagauggcaagggagaaucaaaccaccgcgaagggaaagaaaaacagccaacaacguuacaaaagaauugaagacgccaucaaaaaccucgccccagggcuggauucaacaauucucaaagaacacccgaccgauaacauacaacugcagaaugaccgccuauuucucuacuaccugcaaaacggucgcgacauguacaccggcaagccccuggaaaucaaccaacuaucaaacuacgacauagaccacaucauaccccaggccuucauaaaagacgacucccuagacaacaggguccucacaucgucgaaggaaaaccgcgggaaaagugacaacguccccucacuagagguagucgagaaaaugaaagccuucuggcagcaacuccucgacagcaaacuaauaucggagcgaaaauucaacaaccuuaccaaagcagaacgcggcggccuggaugagcuugacaaagucggcuucaucaagcgacagcucgucgagacgcgccaaaucaccaaacacguagcccaaauccucgacgcgcgcuucaacaaagaagugacagagaaaaacaagaaaaacagaaauguaaagaucauuacccucaagucgaacauggucucaaacuuccgcaaagaauuuggacuguacaagguacgagaaauaaacgacuaucaccacgcccacgacgcauaccuaaacgcgguggucgcgaaagcgauccucaagaaauacccaaaacuagaacccgaguucgucuacggagacuaucaaaaauacgaccuaaaacgguacaucucuaaaucaaaggacccuaaggaaguugagaaggcgacagaaaaauacuucuucuacucgaaucuccucaacuucuucaaggaagaaguccacuacgcggauggaaccauagucaagcgcgagaacaucgaauacuccaaagacaccggagaaauagccuggaauaaggagaaggauuucgccacgaucaagaaaguacucagcuucccacaaguaaacauagucaagaaaaccgaggaacagaccguaggccaaaacggagggcuuuucgacaacaacauaguaucaaaagaaaaagucguagacgcaagcaaacucauacccaucaagucgggacuauccccugaaaaguacggaggcuacgccagacccaccauagcguacucgguccuagucacguauaagcaaaacaacaaaaucaaaaacaccauggucgggauacccguccucacaaaacuugaguucgagcgagacccgaaccucuaucuccgaaaccugggcaucaauaacgugagccacguaauaaaacucgugaaacacaccguacucgaguucaaacacaaauacggaacguaccgccgguucauuguuuccaaccaagaacucaagcgcgccaaccagauauucguaaccacuaagcaaaugaagcugauaagccaauacacaacacuggacaagaacgaacacgacucacuacucaaaaacaaccagcagcucauccaauccauauggaaccaauuccuggaguucaugcuggccacagaccuagugaacaagaaacaauacgacgaacuaauccugaccaacaaccagacgauagaggagugccggaacaucaugaaccgggucaucacaacacuuucguucacaaacauaaacgcaggacagaaaaagaucauuuucgaugacacacucucccugccuaucaaacgcuggcaguucacggacuccgacaagauggugaagaaaauaaucgaaagcacccucauccaucaaucgaucacaggacucuacgaaacacguaucgaccuaaauaaauuaggggaagauuga

SEQ ID NO: 6675 - RNA, 4137 nt, Artificial Sequence
  Cas9 variant
augaacaaaccuuacucgaucgggcucgacauaggcaccaacuccguuggcugguccaucaucacggacgacuacaaagucccugcaaagaaaaugcgcguacucggcaauaccgacaaggaauauaucaagaaaaaccucauuggggcguuacucuucgacggcggcaacaccgccgccgaccgccgccuaaaacgcaccgcacgcagacgcuacaccaggcguaggaaccgaauacuauaccuacaagaaaucuucgcugaagaaauguccaagguggacgacuccuucuuccacagacucgaggacucguuccuuguggaagaggacaaacggggcagcaaguacccaaucuucgcgacaaugcaagaggaaaaauacuaccacgaaaaauuucccacuaucuaucaucugcgaaaagaguuagcggacaagaaagaaaaagccgaccuccgucucaucuaccuggcccuggcacacauaaucaaauuuagaggccacuuccucauugaggaugaccgguucgacguacgaaacacggacauacagaaacaauaccaagccuuccuagagaucuucgacaccaccuucgagaacaacgaccuucuaagucagaacguggacgucgaagcaauacuaacagacaagauauccaagagcgccaagaaagaucguauuuuagcacgcuaccccaaccaaaagucaacaggcaucuucgcagaguuccucaaacuaaucguaggcaaccaagccgacuucaagaaacacuucaaccuugaagacaaaaccccacugcaauuugccaaagacucauacgacgaggaccucgaaaaccuacuaggccaaaucggggacgaguucgcagaccuuuucuccgccgcaaagaaacuuuacgacagcguguuacugagcggaauccucacagucauagaccuuucuacaaaagcaccccuuagcgccucgaugauacaacgauacgacgagcaccacgaagaccuaaaacaccuaaagcaauucgucaaagccucacugccagaaaacuaccgcgagguuuucgccgacucaucgaaagauggauacgccggcuacauagaggguaaaaccucccaggaggccuucuacaaauaccuccucaaacuacuuaccaaacaggaaggaagcgaauaccuccuggagaaaaucaaaaacgaggacuuccugcgcaaacaacgcacauucgacaacggaagcauaccccaccaaguacaucuuaccgaacuccgcgcaaucauucgccgucaaucagaguacuacccuuuucugaaagagaaccuagaucgcaucgagaaaauccucaccuuccggaucccauacuacgucggaccucuggcgagggagaaaagugacuucgcguggaugacccggaagacagaugacaguauccgaccauggaauuucgaagacuuaguugacaaggagaaaucagcagaggccuucauccaccgcaugacaaacaacgacuuauaccucccagaagaaaaaguccucccaaaacacucccucaucuacgagaaguucaccgucuacaacgaacugacuaaggugcgauuccuagcggaaggcuucaaagacuuccaauuccucaaucgaaaacaaaaagaaacgauauucaacucacucuuuaaagaaaaacgaaaagucacugagaaagauauuaucuccuuccucaauaaaguggacggguaugaaggaaucgcaaucaaaggaaucgaaaaacaguucaaugcgucccugucaaccuaccacgaccuuaagaaaauccuuggcaaggauuuccuagacaacacagacaacgaacuaauacucgaagacaucauacaaacccuaacccuuuucgaagaccgggagaugaucaagaagagacucgacauuuauaaagacuucuucaccgaaucccaacucaagaaacucuacagaagacacuauacaggguggggcagacucucagccaagcucaucaacggcauccggaacaaagaaaaccagaaaacgauauuagacuaccucaucgacgacggcuccgcaaaccguaacuucaugcaacugaucaaagacgcaggucuaucguucaaacccaucaucgacaaggcucgaacgggcucccacagcgacaaucucaaagagguagucggagaacucgccggaucuccagcuauuaagaaaggaauccuccaaagucugaaaauagucgacgagcuagucaaaguuaugggcuaugaacccgaacaaaucguuguggagauggcgcgagagaaccaaacgaccgcaaaaggacugucacguagucggcaacgccucacgacucugcgggagagucugggcaaucucaaaagcaauaucuuggaagaaaagaaacccaaauacgugaaagaccaaguugagaaucaccaccuaucagacgaccgccuauucuuguacuaccuccaaaacggcaaggauauguacacugacgacgaauuggacaucgacaacuuaagccaauacgacauagaccauaucauaccgcaagccuuuauuaaggacgacagcauagacaacagaguccuugucagcagcgcuaaaaaccgggguaagucugacgauguccccuccaucgaaauagucaaggcuagaaaaauguucuggaaaaaccuccuggaugccaaacuuaugucccaacgaaaauacgauaaccucaccaaggcggagcgaggaggccucacguccgacgacaaagcccgauucauacagcgacaacuugucgaaacccggcagauaacaaagcacgucgcccggauacucgacgaacgcuucaacaacgagcucgacucuaaaggacgucgaauaagaaaagucaagauagugacucugaaaucaaaccuaguaagcaacuucagaaaagaguucggauucuauaagauccgcgaagucaacaacuaccaccacgcucacgacgcauaccucaacgccgucgucgcgaaagccauccuaacgaaguacccacaacuagaaccagaguucguauacggacuauaccgccguaaaaagcuaucgaaaaucguaagagaagacaaagaagaaaaguauuccgaagccacacgcaaaauguucuucuacaguaaccuaaugaacauguucaagcgaguaguccgccucgcagauggguccaucgucguccgacccgucauagagaccggccgcuauauggguaagaccgccugggauaaaaagaaacacuucgcaacgguccguaaaguccuaagcuauccacaaaacaacauaguaaagaaaacagaaauccagaccggaggcuucuccaaagaaagcauauuagcacacggcaacuccgacaaauugauaccucgcaaaaccaaagacaucuaccuagaccccaagaaauacggcggguuugacuccccaaucgucgccuacucuguacucguggucgcagacaucaagaaagggaaagcgcagaaacugaaaaccgucaccgagcugcucggcauaaccauaauggaacgaucacgauucgagaaaaacacaucugcauuccuggaguccaaaggauaucucaacauccgugacgacaaacugaugauucuacccaaauacagccuauuugagcuagagaacgggcgaagacgacuacucgcaagugccggcgaacuccaaaaaggaaacgagcucgcccuccccacccaauucaugaaguuccucuaccuagccucccgauacaaugaaucgaaaggcaaacccgaggaaauagaaaagaaacaggaguucguaaaccaacauguauccuacuucgacgacauacuccaacucaucaacgacuucagcaaccgcgucauucucgcggacgcaaaccuagagaaaauaaacaaacuauaccaggauaacaaagaaaauauccccguugacgaacuagcgaacaacauaaucaaccucuucacuuucaccucgcucggugcaccggcugccuuuaaauucuuugauaaaaucguagaucgaaaacgauacacgagcacgaaagagguccugaacucgacacucauacaccaaagcaucacgggccuauacgagacgcgcauagacuuaggaaaacucggcgaagguuga

SEQ ID NO: 6676 - RNA, 4137 nt, Artificial Sequence
  Cas9 variant
augacgaacgaaaaauauucuaucggccuggacaucggcacgucgagcauaggauucgcuguaguaaacgacaacaaccgggucauccgagucaaggggaaaaacgcuaucggaguacgacuauucgacgaagguaaagcagcggcagaccgucgcucauuccgcaccacccgcagacggcuaagcagacgccgauggcgacuaaaacuacuacgcgagauauucgacgccuauaucacgccagucgacgaggcauucuucaucaggcucaaagaauccaaccugagcccaaaagacuccaagaaacaguacucaggcgacauccucuucaaugacagauccgacaaagacuucuacgaaaaauaccccaccaucuaucaccuccgcaacgcccugaugaccgaacaucguaaguucgacgugcgagaaauuuaucuagccauccaccauaucaugaaguuccgaggccauuuccuaaaugcuaccccagcgaacaauuucaaagucggacgccucaaucucgaagagaaauucgaggaacuaaacgacaucuaccaacgaguuuucccggacgaaagcaucgaguuccgcacagacaaccuagaacaaaucaaagagguauuacuagacaacaagaggucccgcgccgaucgacaacgaacacucgucucugacauauaccaauccucagaagacaaagauaucgaaaaacgcaauaaggccgucgcuaccgagauucucaaggcuagccuuggaaauaaagccaaacuaaacgucaucacgaacguagaggucgacaaagaggcagcaaaagaauggagcaucaccuuugacagcgaauccaucgacgacgaccucgcaaagaucgaaggacaaaugaccgacgauggccacgaaauuaucgagguucuccgaucacuauacucagguaucacacucucggcaauaguccccgaaaaccacacacuuucccagagcauggucgccaaauacgaccuccauaaagaccaccuaaaacuauucaagaaacuaaucaacgggaugacggacaccaaaaaggccaaaaaccuccgugcggcuuaugacgguuacaucgacggcgucaaagggaaaguccucccgcaagaagacuucuauaaacaaguccagguaaaccucgaugacuccgccgaagccaacgagauccagacauacauagaccaagauaucuucaugccuaaacaaagaacaaaggcaaacggcucgauaccucaccaacugcaacagcaggaacuggaccagaucaucgaaaaccaaaaggcauacuacccauggcuggccgaacugaaccccaaccccgacaaaaagcgccaacaacucgcuaaauacaaacuugacgagcuggucacauucagaguacccuacuacgucggccccaugaucaccgccaaagaccagaaaaaccaaucgggagccgaguuugcguggaugauucgcaaagaaccuggaaacauaacaccauggaacuuugaccaaaaaguagaccgcauggccaccgccaaucaauucaucaaacggaugaccacaacagacacuuaccuacucggcgaagacguccuccccgcccaaucgcucuuauaccaaaaguucgaaguccucaacgaacugaauaagauccgaauagaccacaaaccaaucagcaucgaacaaaagcaacagaucuucaacgaccucuucaaacaauucaaaaacgucacaauaaaacaucugcaggacuaccuaguaagccagggccaauacagcaaacgcccucuaauagaaggauuagcggaugaaaaacgauuuaacucgucccucuccacauacucagaucucugcggaauauucggggcuaagcucgucgaagaaaacgaccgacaggaagaccucgaaaagauaaucgaauggucuaccauauucgaagacaagaaaaucuaucgagccaaacugaacgaucuaaccuggcugaccgacgaccaaaaagaaaaacucgccacgaagcgauaccaaggaugggggcgacugagccgcaagcugcucguagggcucaaaaacuccgaacaccggaauaucauggacauccuauggaucaccaacgaaaacuucaugcaaauacaagccgagcccgacuucgcgaaauuagucacggacgccaacaagggcauguuggagaaaaccgacucacaagacgucauuaacgaccuguauacguccccacagaacaagaaagccauccgccagauacuacucgucgugcaugacauccaaaacgcgaugcauggccaggcgcccgcaaaaauccacgucgaguucgcccgaggcgaggaacgaaauccgcggcggucuguccaaaggcaacgccagguugaagccgccuaugagaaagucaguaacgaacucgucagcgccaaggugcgccaagaguucaaggaagcuaucaacaacaagcgagauuucaaggaccgccucuuccucuacuucaugcaaggaggcaucgacaucuacaccgggaagcaacuaaauauagaccagcuaucauccuaccaaaucgaccacauccucccacaagccuucgugaaggacgacucgcucacgaaucggguccucaccaacgaaaaccaaguaaaggccgacuccguccccaucgacaucuucggcaagaaaaugcucucgguauggggccgcaugaaagaccaagggcuaaucuccaaagggaaauaucggaaccuaacgaugaacccagagaacaucagcgcucacacagagaacggauucauaaaccggcaacugguagaaacgcgccaagucaucaaacuugcagucaacauccucgcagacgaguacggggacucaacacagaucauuucagucaaagccgacuuaagccaccaaaugcgcgaggacuuugagcuucucaaaaaucgcgacguaaacgacuaccaccacgcauucgacgccuaccuugcagcguucauuggcaacuaucuacuaaagagauacccaaaacucgaguccuauuucguguacggcgacuucaagaaauucacccaaaaagaaaccaaaaugagaagauucaacuucaucuacgaucucaaacacugugaccaaguagugaacaaagagaccggggaaauccuauggaccaaagaugaagacaucaaauacauccgacacagcuuugccuacaagaaaauccucguaucgcacgagguucgcgaaaaacgcggcgcccuauacaaccaaaccauauacaaagcgaaagacgacaaaggaucgggccaaggcagcaaaaaguuaauccgcauaaaagacgacaaagaaacaaaaaucuacggaggauacaguggcaaaucccucgccuacaugacuaucguacaaaucaccaagaaaaacaaagugagcuaccgaguaaucggaauacccacccuagcguuagcacgauuaaacaaacuugaaaaugacagcaccgaaaacaauggagaacuguacaaaauaaucaaaccccaauucacucauuacaagguagacaagaaaaauggagagaucaucgagaccaccgacgacuuuaaaaucgugguaucgaaaguccgauuccaacaacugaucgacgacgccggccaauucuucaugcucgcgucagauaccuauaaaaacaaugcucagcagcuaguaauaagcaauaacgccuugaaggcgaucaacaacacaaauaucacggacugcccacgggacgaccucgagcgccuagacaaccuaagacuagauucggcauucgacgagauagucaagaaaauggauaaauauuucucagccuacgacgcaaacaacuucagagagaaaauaagaaacuccaaccucaucuucuaccaacuccccguggaagaccaaugggaaaacaauaaaauaacagaacucggaaaacguaccguccuaacgcgaauccuacaaggauugcacgcgaacgcgaccacuaccgacaugagcaucuuuaaaauaaaaacgcccuucggccaacuccgacaacgguccgggauaucacucagcgaaaacgcgcaacuaaucuaccaaagucccaccggacuauucgaacggcgaguucagcuaaacaagaucaaauga

SEQ ID NO: 6677 - RNA, 4137 nt, Artificial Sequence
  Cas9 variant
augaccaacgaaaaauacuccaucggccucgauaucggaacauccuccauaggauuugcagucguuaacgacaacaacagaguaaucagggucaaaggcaaaaaugcaauaggaguccgacuguucgacgagggcaaagcagccgcggauaggcgaucguucagaacaacccgccggcggcucuccagaagacgauggagacuaaaacuccuaagggagauauucgacgccuacaucaccccagucgacgaagccuuuuucauccggcucaaggaaucaaaucuaucacccaaagacucaaagaagcaguacucuggcgacauacuauuuaacgaccgcuccgacaaagacuucuacgaaaaauacccaacaauauaucaccuacggaacgcucuaaugacagagcaccggaaauucgacguccgcgaaaucuaucuugccauccaccacaucaugaaauuccgcggccacuuccucaacgcaaccccggccaauaacuucaaagucggacgacucaaccucgaagaaaaguucgaggagcuaaacgacaucuaccaacgagucuucccagacgaaagcauagaguuccgaaccgacaaccucgaacagaucaaggaaguccuacucgacaacaagagaagcagagcugaccggcaacggacacucguauccgauauauaccagucaucggaagauaaagacaucgaaaaacgaaacaaagcagucgccaccgagauucucaaggccucacuaggcaacaaagccaaacucaaugucaucacaaacgucgaagucgauaaggaggccgccaaagaguggucaauaaccuuugacagcgaauccaucgaugacgaccucgcgaaaaucgaaggacagaugaccgacgacgggcacgaaaucaucgaaguccuccgaucccucuacucggggaucacacucuccgccauagucccagaaaaccacacccuaucgcagucaaugguggcuaaauaugaccuccacaaagaccaccuuaaguuauucaagaaacugauuaacggaaugaccgacacgaagaaagcgaaaaaccucagagccgccuacgacggauacaucgauggcgucaaagggaagguccugccccaggaagauuucuacaaacaaguacaagucaaccucgacgacagcgcagaagcaaacgagauccagacauacaucgaucaagacaucuucaugccuaaacagagaaccaaggcaaacggauccauuccgcaccagcuacaacagcaagaacuagaccaaauaaucgaaaaccaaaaggccuacuacccauggcuagcagagcuuaauccaaaccccgauaagaaacgccaacaacuagcgaaauacaaacuagacgaacuggugaccuuccgcguccccuacuacguaggcccuaugaucaccgccaaagaucagaaaaaccaaucaggggccgaguucgcauggaugaucagaaaggagccaggcaauaucacgccauggaacuucgaccaaaagguagacagaauggccacagcgaaccaauuuaucaaacggaugacaaccacugacacguaccuacucggcgaagauguccucccggcccaaucccuccuauaccaaaaauucgaaguucucaacgaacucaacaaaauacgcaucgaccacaaaccgaucuccaucgaacaaaaacaacaaaucuucaacgaccuguucaagcaauucaaaaacgucacaaucaaacaucugcaggacuaccuggucucgcaggggcaauacuccaaacgcccgcucaucgagggccuugcagacgaaaaacgcuuuaauucaagccuuuccacuuauagcgaccucugcgguaucuucggcgccaaacuuguggaggaaaacgaucgacaagaagaccuagagaaaaucauagaauggagcacgaucuucgaggacaagaaaaucuaucgagccaaacucaaugaccuaaccugguuaacggacgaccaaaaggagaaacucgcaacaaaacgcuaccagggauggggaaggcucucacgcaaacuucuagucggucucaagaacagcgagcaucgaaacaucauggacauacuguggauuaccaaugagaacuucaugcaaauccaggccgaacccgacuucgccaaacucgugacagacgcaaacaaaggaaugcuagaaaagacagacucgcaagacgucauuaacgaccuauacacaagcccacaaaacaaaaaggcaauccgccaaauccuucuagucguacaugauauccagaacgcaaugcaugggcaagccccagccaagauccacguggaguucgcccgaggagaagaacgcaacccgcggcgaagcguacaaagacagcgucaagucgaagccgccuacgaaaaaguuagcaacgaacuugugagcgcgaaagucaggcaggaguucaaggaagcaaucaacaacaaaagggacuucaaggaccgucucuucuuauacuucaugcagggcggaaucgacaucuacaccgggaaacaacuaaacaucgaccaacuaucauccuaucaaauagaccacauacugccccaggcuuucgucaaagacgauucccuaaccaaccgcguccucacuaacgaaaaccaaguuaaagccgacuccguacccaucgacauauucggcaagaaaaugcuuucagucuggggccgaaugaaggaucaaggacugauuagcaagggcaaauaccgcaaccucacgaugaaccccgaaaacauaagcgcccauaccgaaaauggauucaucaaccggcagcuggucgaaacacgccagguaaucaaacucgcgguaaacauccuggcagacgaauacggagacucuacacaaaucaucagcguuaaagccgacuuaucccaccagaugagagaggacuucgaacugcucaagaaccgcgacguuaaugacuaccaccacgccuuugacgccuaccuagcagccuucauuggcaacuaccuguuaaaaagauacccaaagcuagaaucguauuucguauacggggacuucaagaaguuuacacaaaaagaaaccaagaugcgacgcuucaacuucaucuacgaucuaaagcacugcgaccagguaguaaacaaagaaaccggcgaaauucucuggacaaaggacgaggacauaaaauauauccgccaccuuuucgcauacaagaaaauacucguaucacacgaagucagggagaaacggggugcguuguacaaccagaccauauacaaagccaaagacgacaaaggcucuggccagggauccaagaagcugauccgcauaaaggacgacaaagaaaccaaaaucuacggaggcuacagcggaaaaucgcucgccuauaugacaauaguacaaauaaccaagaaaaauaaaguuagcuaccgggugauagguauacccacgcucgcccucgcccgccuuaacaaguuagagaacgacuccacggaaaauaacggcgagcuauacaaaaucauaaagccacaauucacacacuacaaaguggacaagaaaaacggcgaaauaaucgagaccaccgacgacuuuaaaaucguagucucaaaaguccguuuccaacaacucaucgacgacgcaggacaguucuucaugcucgccuccgacaccuauaaaaacaacgcgcagcagcuagucaucagcaacaaugcgcuaaaagcaauaaacaacaccaauauaacagacugccccagagacgaccuggagcgguuggacaaucuccgccucgacucagccuucgacgaaauaguaaagaaaauggacaaauacuucuccgccuacgacgcuaacaacuucagagaaaagauccgcaacucuaaccuaaucuucuaccaacugccggucgaagaccagugggaaaacaacaaaauaaccgaauuaggcaaacgaacaguccucacgcggauucuacaaggguuacacgcaaacgcaacaacaaccgacaugagcaucuucaaaaucaaaaccccauucggacaacuaagacaacgcucaggaaucagccuuuccgaaaacgcacaacugaucuaucaauccccuacggggcuuuucgaacgcagaguccaacucaacaaaauaaaauga

SEQ ID NO: 6678 - RNA, 4140 nt, Artificial Sequence
  Cas9 variant
augaaacaaaucuugggccucgaccucgguacuaccagcaucggcugggcacugguacgagaagcggaaaacaaagacgagcagucuucaaucgugcgcaucggagugcgcgugaacccacucaccagcgacgaacaaaagaacuuugagcaaggaaaauccauaaccacgaacgcagaccgcacccucaaacgcucaaugcgucguaaccuccaacgcuauaaacuacgccgggaucaccucaaggacugccuacaaaagaacgggaucaucacagacaaggccguccucagcgagaacggaaauuacaccacauuccaaacguacuaccucagggccaaggcgguaaacgagaaaauuucauuagaagaguucgcccgcguucuccucaugcucaacaagaaacggggcuacaaauccucccguaaaaugaaaagcgcagacgaaggacagcucauagacggcaugucagucgcgaaaagacuauacaacgauaacaucacgcccggacaauacguccuaagucuccucgaagaaggcagaaaguacaucccagacuuuuacagaagugaccuccuagacgaacuugacaaaauauggacuuuucaacaauguuucuacccagaaauucuaacgccagaaugccgaaaacucaucgcaggaaaaggcaagcaagccaccgccaaaaucuuccuugggaaguacaagaucuacacagcagacaacaaauccaaagauaaacgccuacaagccuaccaauggcgagucgaagcccucagcgggcaacuacccauagaaguaguagcguucguagucugcgaaauuaacggcgcaauccaagccucaaguggcuaucucggagccaucuccgaucgauccaaagaacucuacuucgaaggccucacagucgggcaguaccucgucaagcagcucgagaaaaacccugacacaucgcugaaaaauaaaguguucuaccgccaagacuaccuaaacgaguucgaaaagauuugggaaaaacaggccgaauaccacacagaacugaccccacaacuaaagaaggaaguccgagacauaauaaucuucuaccagcggacccucaaaagccaaaaaggccucgucggguucugugaguucgaaucccgucagaucgaagucaugauagacggcaagcucaagaaaaagaccgucggaugccgugugugcccaaaguccagcccccucuuucaggaauacaagaucuggcacaaccuaaacaaucucaaaauagucgaaaaggaacuagguaaaucacgauuccucaaucaggacgaaaaggaaucccuauuccaagaacugaacaucaaagaaaaacucuccaaaacagacauacucaaacuucugugccucaaagccaaagaauuugaccucaacuucgaaaaaguagaaggcaaccgcacucaagcggaacuauucagagccuaccaagccaucauagaaaugagcgguaacggcgacuacgacuucuccaaaaugacgucuagcgaaauacaggacacagucacaggagucuucagaggccucggcuacaacacggacauccucagcuucgacgccgaaaaagaagagaaaaccuucgacaaacagccuauguacuuacuguggcaccuccuauacagcuacgagggcgacucaucggacaccggcaacaaagcacuuaucaccaagauaaagaaacuuugcggauuugaaagcgaagaauaugcccggauccugacggacgucacuuuccaauccgaauauggaaaccucagcaccaaggccaucaggcggauucucccuuuuaugaagaagggcuccgaauacagcgaagccugucggcacgcaggcuauagacacagugagcgcagccucaccaaggaagaacucgacaagaaaguauacaaagaccaccucgagcuccucccacgcaacucgcugcgaaaucccguagucgagaaaauccugaaucaaaugauacacguaguaaauaccgucguagauacguacggaaaaccagacgaaaucaggaucgaacucgcacgugaacuaaagaaaucagccaaagagcgagacgagaugacugccucuaucaacaaaaccgcagccgaacacaagaaauacugcgagguccugcagaaagaguucggcuucacucacguaucacgaaacgacauaauccgauauaaacuguaccucgaacuagaaaacaacggauacaaaacacucuacucggacacuuacaucccucgugaaaaacuauucaguaaggaguucgacaucgaacauauaaucccccaauccaaacucuucgacgauucauucuccaacaaaacccuagaaugcagauccgucaacaucgaaaaauccaacgacaccgcauaugacuauguccuuaacaaauacggagaacaagggauccucgacuauaaaaaccgaaucgaaaaccuguacaaagacuccaaaaucucacgaaccaaauaccaaaagcucaugaugaaaaacagcgacauaagcggcaacuucauagaacgcgaacuuagggacagccaguacauugcuaagaaagcacgcgaaauucucgaagaacugguaaaauuuguggugcccaccacgggauccgucaccgcgcgccuucgcgaagacuggcaacuugucgacgucaugcaagagcuaaacuggaagaaauacgauaaacuaggccugaccgacguccgguaugacaaagacggacgugaaauacguuacauuaaagacuggucaaaacgcaacgaccaccgccaccaugccauggaugcgcugacgaucgcguucaccaaacgaagcaucauacaauaccucaacaaucugaacgccaagagcgacaaauccgguucgauauaugcgauagaacaaaaggagcuauucagagacaaaagagggaaacuuaaauucaucccacccaugcccuguaacaucuuccgggcggaagccaaacgacaccucgagaacguccuuguaucgguaaaagccaagaacaaagucgucaccccgaacauuaaccgaagcaaggggaaaaacggcaucaacaaaaagauccaacuuacgccucgaggccaacugcacaacgaaacuaucuacgggaguaugaagagauacgagacgaagugggagaaaauaggaagcggcuuugacgaacgccagaucgccaagguggccaacaagaaauuccgcgaagcccuacuuucccgccucgccgaguucggcaacgacccccaaaaagccuucacaggcaaaaacagccucgagaaaaauccccuauacguggacgaacuccacacccaaaaagucccagaaaaagucaaaauagucacccuagaaaaucucuauaccauaaggaaggaaauaacccccgaccucaaaaucgacaaaguaguggacgccggggugagacgcgugcugcaagaacgcuuggacgaguucgaugaugacuccaagaaagcauucuccaaccuagaugaaaacccuaucuggcucaacggaaagaaaaugaaacgcgugacgaucaugggcgugucuaacgccgucccucuacacgacaagaaagauuacaaaggcaaccuuguguucgacucgaaagggcgaaaacaaccagucgacuucgucaacaccggcucaaaucaccacgucgcuauuuaccgcgacgaauccggugaacuccaagacauaguagucuccuucuacgaagcaacaacaagaucuacccuuggcauccccgucaucgacaaagaguauaagaaagcggaaggguggaacuuccucuucagcaugaagcaaaacgaauacuucgucuucccaaacgaagagacgggcuuuaacccaaaagaaauagaccugaugaacccggauaacuacacuaccaucucacccaaccucuaccgaguccagaaauucagcaagugcauguacgggaacuccucgguccgagaguacgucuuccgacaucaucuggaaacgucaguaaacgacagcaaaggacucaagaacauagccuacaaaaacgucaaaagccuagucuaccucgaagggaucguuaaaguacgcauaaaccacaucggccaaauagucuccgucggagaauauuga

SEQ ID NO: 6679 - RNA, 4140 nt, Artificial Sequence
  Cas9 variant
augcgcaucgacaauggacucgaggagcugaaagucaacaaccgcauauauaauaucggacuagacauaggcacaaguuccgucggauucgcagucacugacgcacaggacaaacucguacgagucaaaggcaaaaccgccauaggcguacgccucuucgaagagggacacaccgcagcugaacggagaggcuucagaacaacacgacggagacuuagcagaagaaaauggcgcaucaaccuccucaaccagaucuucgagcccuacaucuccgaaauugacccgacauucuucgcgcgacuuaaaaauucaucacucgccggaaaagauaagaaauucgagggaucccuacuuuuccccgaccggacggauuaccaguucuacaaagauaauccgacaauguaccaccuccguaagcaccuaauggaaaaagaccgccaguuugaccuacgggaaaucuaccucgcaaugcaucacaucaucaaauaccgcggcaacuuccucaacaccacaccaaugaaccacuuuaaaaacgaagaaauagacuucuccgcguuauucucccgacucaacgagcuuuaccaggagaucgaugacgagaacaucuucgaacucaacaucgagaacgucgacgaaauaaagaaaaucuuacuaaaccacgaucuguucaaaauggaaaagcagaagcaaguagccaagcuacugaaugucgacaccgacgacaaacaacucaagaaagagaauaccgcccuagccuccaacuucagcaaagcgauacuaggguacaaauucaaucuggcccucgucaccaagauaccagaucaagacaagaaagaguggaccaucagccuaggggacgaggacuuugacgaccgucucgacaacguccccgucgcacuaacagaaucgcaacuggaaguagucgaaguccuccacucaauauuuaacagcaucucacugaacgaaaucguggagaacggcgaaacucucucauccgcgaugguacgcaaauauaacgaccacaaacacgaucuuaaacugcugaaaaacguaaugacaacacucgaagaucgcaagaaagccaaaaagauccaaggaaucuacaaugucuucgucggcaaggacaccgaccucaucagcgacaaggacaaaaauaaauacaaagacaaggaugaguucuacaaagaaauucagaaaaaccuagauaacagcuccgacgccgaagaaaucauaaagcgcaucaaacaggaccaauuccuacccaaacagcgaacauccaaaaauggaguaauaccccaccagcuacaccaacgcgaacuagaccuuaucaucgaaaaucaagccaaauacuaccccuuccugaaggaggccaacccuaacaagaaacggcucaaacaggcaaaauacaaacuggacgaacucauagccuucaaaaucccauacuacauuggccccaccucaggagcagaaaacagcgacuuuucuuggcuaaaacgcaaaaaggacggacaaaucacaccguggaacuucgaugagaagguagaccgaaucgagagcgcaaaccgcuucauccgacgcaugacuacgaaggauaccuaccuccucgccgaagacguccucccccucgaaucccugaucuacgaaaaauacuccguacuaaacgaacugaacaaugugagaaucaaccgacaaaaacucucugucaacgacaagcaggacaucuacaacgagcuauucaaaaauagcaaaaccgucacgcugaaacaacuccagaaauacuucgaagugaccaaaaagcucaagacagucgucgucgaaggccuugcggacccgaaaaaguucuuauccaaccuagggacauaccacgacuuuaaacuaauuuuuggagauaucguagacgacccagaauaucagaccgaccuagagaacauaauugaguggagcaccaucuucgaagaccgcggaauauucaacucaaagcuaaacgaaaucacauggcucaccgaugaacagaggaagaaggugcucagcaaaagguaccagggcuggggccgcuucuccaaaaagcuacucgugggccugaaaaacucacagggaaacucuauacuagacgaacuauggaauacgaaccuaaacuucaugcagcuacaaagccaggacgauuucgcagaacuaauacacgccgaaaacgcgaagcaauucaaagccaacgaccccgacaaucccuggaacggcaucgacgcaauucucaaugaugcuuacacaagcccacaaaacaagaaggcaauccgccaagucgucaaaguaguacaggauaucgaaaaagccauggguaacaaaccacagaaaaucgcgauagaguucacccgguccgccgacaaaaacccaaggcgaacagacucccgcaucaaacgcuuaucggauaucuacaaggaagcugccgaaaaagucgucggagagucccuaaaacuugagcugaacgaauaccucaccagcaaaaagaaaaugaccgacaaaauguaccuguacuucacgcaacuaggaacggacaucuacacaggcaaaaagaucgacaucgaccagcucaacaacuacgacauagaccacguacuaccgcagagcuuccucaaggacgacagccucgacaaccgaguacucacgaaccgauccgacaacuccgaaaagagcgauacggucccacuacauaaguucggagcaaaaaugggaaacuucuggcgacaacuagccgacgaaggucucaucaccaagagaaaauacaaaaaucucaccacggaccccgcgaccauagauaaauacaccauccaaggauucaucagacgucaacucgucgagaccucucaagugaucaaacuuaccgcaaacauucucggcggacucuauccagaagagacggaaauccuggagaucccagccaagcuaaaccaccaauuccgggauauguucgaccucguaaaagugagagaagucaacgacuaccaccacgcguucgaugccuacaucacaguauucgucggaaacuucuuauacagacgcuacccgaagcuacgcucauacuuuguauacggagacuucaagaagcuaaacaaaacagaugacgacauaaggaaauucaacuuccuaaaccucuucaacaaagauaaaguagaggacaacgagacagacgaaauucuuuggucaaaagccgagagcauccgggacauuaaaaacaucuacaacuauaaauucaugcuagugucgcgcgaaguauacacgcgccacggugcaauguucaaccaaaccauauaccccgcgucaaagaacgacucaaagaaacucauacccauaaagaaaggaaaagacaccgcuaucuacgggggauacuccggcaacacugacgccuacauggcaaucguugccgucgaggacaagaaaggcgagaaauucaaagucgugggagucccgacccgggcagucagccgccucgaacagcuugcagcagacgaccacgaccaguaccucacagcgcuacaugacguccugaagccaaacuucacaaagaucaaaacaaaucgaaaaaccaaagcaaaggaagaagucaccacaccuuuccgaauccuaguagguaaagucggguaucgccagcugauccaagacggucaaguaaagaugaugcucggaaguagcgcguacaaauacaacgcgaagcaacugguacugagcgaaaagucccucaagguaauaaagaacaacaagaaguacaaccccgacgacgaaaaccaagaccugauugauguguacgacgaaauccucggcgugguuaaccgcgcauucaaccuuuacgacaccaacggauuccgaaagaaacucaacgacaauaggguuaaauucguugagcuccccaucaacaacaucuuugacgggaccaaauuaguccaaauggggaaacgagccgugcugacccagauccucaacggccuacacgccaacgccgcgcugggugaccucaaagcacucggcaucucaacccccuucggaaaaaugcaaucuaaauccgggauaccccucagcauggacgcaucccuggucuaccagagccccaccggucucuuugaacgcaaacuaaaccucuccgaccuguga

SEQ ID NO: 6680 - RNA, 4140 nt, Artificial Sequence
  Cas9 variant
augacuaagaagaacuacagcauaggacucgacauaggaaccaacucaguaggcugggcagucauaacggacgacuacaaagucccggcaaagaaaaugaaaguacucggcaacaccgacaagaaauacaucaaaaagaaccugcucggcgcacuacuguucgauucgggagaaacggccgaagcgacacgacuaaaaagaaccgcccgccgccgcuacacccgacggaaaaaccgcuugcgcuaucugcaggaaaucuucgccgacgaaauggcuaagguagacgagagcuucuuucagcgccucgacgaauccuuucuccggugggacgacgauaacaagaaacugggacgcuacccuaucuucggcaacaaagccgacguagucaaauaccaucaagaguuccccaccaucuaucaucuucgcaaacaccuugccgacucuagcgaaaaagcagaucugcgccugguguaccuagcccuagcacacaugauaaaauuucggggccauuuccugauagaaggcgaacucaacgccgaaaacacggacgugcagaagaucuucagcgacuuugugcggguguacgaccgcacuuucgacgacagccaccucucagaaauuaccguagacgcagcauccauacuaaccgagaaaaucuccaaaagccgccgucuagaaaaccuaaucaaauacuaccccaccgaaaagaaaaauacccuauucggaaaccugauugcccuggcacucggccuccagcccaacuucaagaugaacuucaaacugucagaagacgccaaacuucaauucucaaaggacaguuacaacgaggacuuggaggaacuacucggaaaaauaggcgacgauuacgccgacuuauucacaucagccaaaaaccucuacgacgcaauccucuugucuggcauacuaacaguggacgacaauucaacaaaagcacccuugagugcaucaaugauaaaaagauacgccgagcaccacgaagaccuagagaagcugaaagaguucauuaaagcgaacaaauccgaauuguaccacgacauauucaaagaugaaacgaaaaacggcuacgcugguuacauagagaacggcgucaaacaagacgaguuuuacaaauaucucaaaaacacacuaagcaaaauagccggguccgacuauuuccuugauaagaucgaacgugaggacuuccuacgcaaacaacgaaccuucgacaacggcucaaucccccaccaaauccaccuacaagagaugcaugccauucuacgacgacaaggagacuacuacccauuccucaaagagaaccaagaccgcaucgaaaagauccucaccuuucggauccccuauuacguaggaccccuagcccgcaaagauucccgguucagcugggccgaauaccacagcgacgagaaaauaaccccguggaacuuugacaaagugauagacaaggaaaagucggcggaaaaauucaucaccagaaugacacucaacgaucucuaccugccggaggagaaaguacugcccaagcacagucacguauacgaaaccuacgcugucuauaacgaacugacuaaaaucaaauacgucaacgaacaaggcaaggacuccuucuucgacucgaacaugaaacaagaaaucuucgaccacguauucaaagaaaaccgcaagguaaccaaagaaaaacuccuaaacuaccuaaacaaggaguuucccgaauaccgaauaaaagaccugaucggacucgacaaggaaaacaaauccuuuaaugcaucgcugggcaccuaccaugaccugaagaaaauucuagacaaagcauuccuggacgacaaagucaacgaagagguuauagaagacaucauaaaaacacugacccucuucgaggacaaggacaugauucaugagcggcuccaaaaguacucggacauauucacugcggaucaacugaagaaauuagaacggcggcacuacacaggcuggggucgauuguccuacaaacuaaucaacggcauccgcaacaaagaaaacaacaaaaccauccucgacuacuuaaucgacgacggcagcgcaaaccgaaacuucaugcagcuaaucaacgacgacacccuacccuucaaacaaauuauacagaaaagccaaguuguaggcgacgucgaugacaucgaagcaguaguacacgaccuaccaggaagucccgccauaaagaaagggauacuucaaucaguaaaaauagucgacgagcuaguaaaagugaugggcgacaaccccgacaacaucgugaucgaaauggcacgcgaaaaccaaacaacaaacagaggacgaucccagucacaacagcgacucaagaaacugcaaaacucgcucaaagaacuaggcuccaacauucucaaugaggaaaaaccuuccuacauagaagauaaaguagaaaacagccaccuccaaaacgaccaacucuuccucuacuacauacagaacggaaaggacauguacacuggcgaugaacuggacaucgaucaccucagcgacuacgacaucgaccacaucauaccccaagccuucaucaaagacgacagcaucgacaaccgcguccuuaccaguagcgccaagaaccgcggaaaauccgacgacguccccucgcucgauaucguccgagcccgaaaagcagagugggucaggcuauacaaaucaggccugaucucaaaacggaaauucgacaaccucaccaaggccgagcgagggggccuaacagaggcagacaaagccggguuuauuaaacgccagcucgucgaaacccgacagaucacgaagcacguagcccaaauacuagacgcaagguucaacacggaguccgacgaaaaugacaaggucaucagagacgugaaaguaauaacccucaagagcaaccuaguaagccaauuccguaaagacuuugaguuuuacaaaguaagagaaauaaacgacuaucaccaugcacacgacgcauaccuuaacgcaguggucggcaccgcacuacuuaagaaauaccccaaacuggcauccgaguucgucuauggggaauacaagaaauacgacguucacaaacuaaucgccaaaagcagcgacgaccauagcgaaaugggcaaagcuacagcgaaauacuucuucuacucgaaccuuaugaauuucuucaaacgggucauacgauauagcaacggcaaggucauagugcgacccguuguugaauauuccaaagacacggaagacaucgcuugggauaaaaaguccaacuuucgcaccaucugcaaaguccucuccuacccccaagucaacauaguaaagaagguagagacgcaaacagggggcuuuucaaaggaaagcauccuccccaaaggcgauucagacaaacucauaccgcguaagaccaagaaagccuauugggacacgaagaaauaugggggcuucgacagccccacggucgccuacuccguauucgugguggccgacgucgaaaaaggcaaagcgaagaaauuaaaaaccgugaaagagcuagugggcaucuccaucauggaacgaucauuuuucgaagaaaaccccgucgaguuccuggagaauaaagguuaccauaacauccgagaagacaaguuaaucaaacucccaaaauacagccuauucgaguucgaaggcggcaaacgacgccuccucgccucugccagcgaacuacagaaaggcaacgaaauggucauaccagggcaccuagugaaacuccuauaccacgcgcagcgcaucaauucguuuaacucaacaaaauaccucgacuacguaagcgcccauaagaaagaguucgaaaaaguucuguccugcguagaggacuucgccaaucuguacguugauguagagaaaaaccucucaaaaauccgagcagucgccgacagcauggacaacuucagcaucgaagaaaucagcaacagcuucaucaaucuacucacccugaccgcccucggagcgccagcggacuucaacuuucucggcgagaaaaucccacgaaaacgguacacaucaacaaaggaaugucucaacgcaacgcuaauacaccaaucgaucaccggucuauacgaaaccagaauagaccucagcaagauaggagaagaauga

SEQ ID NO: 6681 - RNA, 4143 nt, Artificial Sequence
  Cas9 variant
auggggaaauacaaccuaggauuggacauaggaacuaacagcguaggcugggcgguugucgacgaaaacaaccagaucgucaagaaagguggaaaggcccuauggggcgugagaauguuugacgaagcccaaucggccaaggaaacccgcaucuacaggaacagcaggcggcgcauaguacggcgcaaccagcgccuccuccuacugcaaaaggaguucuacgacgaaauaaucaaagucgaccaaacguucuuccaacgucucaaagacuccuuuuucaaaaaggaggacaagcuaaacaaaaacaacuacaccuucuucgacgacgacaucacagaccgcgaguacuucaagaaguucccaacaaucuaccaccuucgaucgcaccuacuauacaacgaugagaaaaucgacauaagaaugcuguaccuggcucuccaccacauagugaaguacagaggccauuuccuugacagcggggaagucaaugaaagcaacuucuccaaaaucaaagacguccuugacaccuucaacaacaaaaugagcgaaaugucccuagaguucgaagacaaugaagauuacuucugcaaaaucgaguucgacgaaaacuucgaaaacaaacucaaagacaucaugcuaagccaguugucaaagaaagaaaagcgacaagaacuaauagaccucuucaaaguggacaagaaaagccuuguuaacgaacuucugauugaacuccucguaaauaagaaagucaaacuaaacagccucucgaucacaaacgguaagaaauacgaaguuugugaaaucgauuucgaaaaagaagaacuauuugagaaacuggaagacgccaaaaagaucaucaccgagcuguucgacauacuggacgaaauaguaaacaucaagaagaucguagacuacuacuacguccucaagaucauaggugauaacgaauaccucucugaagccauggucaagaaauacgacaaacacgacaaagaccuaagagaacucaaauccuuuaucaaaacguacuguccaaacaaauacuacgaaugcuuccgaaaaaccuccaacccgaaucugugcaacuaccccaaauacgucggcauuaauucggucaacaagaagauagagagauucgcgcauuguaagaaagaagaguucuacaaauaccucaagucacucuucaauaccaucaaagacgaaaacgccaagcucaaaaucgacuuguuccaaaaagacauggaaaacgacgacuuccucaaccgccaaaacuccaaccacaauucaagcauccccaugcaacucaauuucugugaacucaaaaagauucuugaaaaucaguccaaguacuacccguuucucaugcucaagaacucagacggauacagcacuuccgaccgaaucauagccauauucaaauacaaaauccccuacuacgucggaccccucaacaaaaacuccaaguacucauggcucguaaagaaaucgaacgaaaacauaacccccuggaauuacgagaaaguuauugaucucgacgcauccgccaaagaauuuauccagcggaugcaaaacaaaugcaccuaccugaaaggggaaaacgacuacugccuccccaaaaagagcauccuguucucugaguacaacugcuuacaauaccucaaccgccugaucauaaacggagcgcucaucgagaacaaauuaaagaacgaaaucuacgagaacaucuuccucuguuacaaaaagccaaccaagaaaagcauaguggaauaccucaaaacgaacuauaacuacgacgaaaccacccuaaagucaaacauacucgaagucaacugugacaugagcuccuacauccaauucaaggaaauauacggcgaagacuucgagcagaaccucaacaucguggaagacauaaucaaagacaucaccaucuucgaggacaagaaaauccuggagaaaagacuacgagaaaucuaccaccuaucagaggacaaaguccagaaaauaaaaggcuuaaacuacaaaggcuacgcaacucugucuaaacauuuccuaaacaacuuuuacucggucaaugaggaaaccggggaaaucuauggaccaaucauccaaaucaugcgagacaccaacuacaaccuucaacaagucauauacaacgaccgcuacaauuucaugaaagcuaucgacaaauacaacaagaagaacuuggauacggagaagaagcucaacguuuccgacuuuaucgaugaauacauuuacgucaguccaauaaugaaacgcucccugauccaauccuacaauauaauacaagaacucgagaaaauccuaggagaaucaauaucuaaguacuacaucgaaugcgcgcguguccgcucgaacagcaaggacgucauuaacucgcgauacagacaacucucagaacuauacaaggacugcgaacaccaaguguccgacauaagcaagaacuacaucaacauaaacaaguuaaagaaacaacucgaggacaacaaaaacgaacuccgagccgacaaacuguaucucuacuucacucaauuuggcaagugcauguacacacuaaaggacauagaccuggacgacgucuuccugggaaaguacgacauagaccacauauacccacagucacucaucaaggacgacucacuaaacaauaggguauuggccuccaaagagaaaaacggaaagaaagauaaccaauuuauauucaacaucccagaguuucugccgaaaaacgcagaacuauucuauaaaaagcugcuugagugcaaacuaaucacaaaagaaaaguauagacgccuaacgaugaaaaagauagacgacgacgaacucgacaucuucgucaaccgucaacuuguagcuacaaaucaaucaguaaaaggccugguugacguccucaaaaucuacaagggcgucaagccgaccaacauaguguacagcaaagccguaaacaucagcgacuuccgcaauaacuauaacuuguacaaaagccggacagcuaacaacuaccaccacgcccacgaugccuaccuaaacgucgugaucggcaaggcacuagacgucuacuaccaaugcaacuacuuccaaaacuauaaagacguaaucaagcugaaagaccgaaacauaacaauaaaccccgaaauuaucuuguccaaaaaccgcuacguaaaccgcaacggggagaagaaaguaaucugggaucuugacaacacccucaaauuaaucaaaaacaaccucuauaaccgcuucgauauaaccgagaccaucaugacccguaaaucaaauaaaauguuuucaaaauccuccaucucccccgccaaaaacuccaagaaccuaaucccgaucaagaccucggacccccgaugcaacguacuaaaauauggcggcaucaagucaaauucuuacaacuucuacugcaucgucgagcuuuacgauaagaaaggcaaaaaguccuacauccuggaggccaucccaaaaacccacuccgacaaacuagaagaauacaucaaaaacagcauagacgagaaaaacgucagcaacuucaaaauuaucaauaaaaacauaaagucgaacauaauuauagaauauaagaagcuccgcuacguuaucacaggaaaaagcggcaaauacuaucucauuaaaaauuucaaagaccggaacuucagcuacaacgcgauaaagacgauaaaguauauagagaaauacaacuaccaaaagaaguacgaaauacccuuugaggagaccaaggaaaagaucauccuagcacccaaaaagaaagacacgaaggagauaagccugacccuagacaacugccaagcacuucuagaugaaauaaucucccuauucaagaaagacaucuacaacuaugacaucauauacaagaucaccucaaaacucgaagagaacaagcagaaucuaacucugaccaaccugaucaaagugcugaccgagaucuugauccuccuaaagacaaaugagagagguacagccgaccucacccuaauugauaugucgaaagacaccggaacccuaugcauaaguaaaacacuaaagcccgguaugaaauuuaucucagaauccccaacuggcuauuaccgaaaaauuauauucgaggugccgaacggaauuuga

SEQ ID NO: 6682 - RNA, 4143 nt, Artificial Sequence
  Cas9 variant
augaaacgaauacucgggcuagaccucggcacaaccucaaucgggugggcacuggugaacgaagcagaaaacaacaacgaggccucaucgaucguucgacuaggaguccgcguaaacccacuaacaguagacgagaaaagcaacuuugaaaaggggaaagccaucaccacaaacgccgauaggcagcuacggcacggagcucgcauuaacuuacaacguuacaagcuacgccgccaaaaccugcacgacugcuuacaaaaacagggauggcucggcaccgaagccauguacgaagagggaaaagccagcacauucgaaaccuacaagcucagagccaaggccgcagaagaggaaaucucucuacacgaguucgcccggguacucuuuaugcucaacaagaaaagaggguacaaauccaaccggaaggccaacaauaaagaagauggccaacucuucgacggcaugacaauagccaaaaagcucuacgaagaacaucucaccccggcagaauacagcuuacaacuucucaacaagggaaagaaauucacacaaggcuacuaccgauccgaccuaaacgcagagcucgaacgcaucugggacgagcaaaagaaguauuacccggagauccucaccgacgaauuuaagcaacagcuggaaggaaaaaccaaaacaaacacaaguaaaauauuucucgcaaaauacggaauauacagcgcagaccuaaaaggguuggaccgcaaguuccagccacucaaguggcgcgucgaagcucugcagcaacaagucgauaaggagguauuagccuucgucauauccgaccugaaaggacagaucgcgaauacgucaggacuauuaggggccauaagcgaccggucaaaggagcuguacuucaacaagcaaacggugggccaauaccucugggccucucuagaagaaaacccccacaucucuaucaaaaacaagccuuuuuaccgucaagacuaccuagacgaguucgagaaaaucugggaaacacaagccgcauuccacaagcaacucacgccagaacucaaacaggaaaucagagacauaaucaucuucuaucaacgcccccuuaaaucaaagaaaagucugaucagugucugcgaacucgaacaacgaaaagucaaagcaaccauagacggaaaagaaaaagaaaucaccaucggaccaaaaguagccccaaagucaucacccgucuuccaagaguuccgaauauggcaaaaccuuaacaacguacuacucaucgacaacgacaccaacgaaaaacgcccacucgacgagguagaaagaaaccuccuauacaaggaacucagcauaaaagccaagcucagcaaaaccgaggccuuaaagauucucaacaagaaaggaaagcaaugggaccucaacuaucgcgagcuggaagggaaucgaacccaagcuauacucuucgacugcuacaaccggaucauaacccucacgggacacgaagaaugcgacuucaagaaaaucaaagccuccgaaauacgccacuacguaucaaccauauucaaaaaccucggcuucuccacagaaauccuugacuucgacccgucacugaagaaacacgaacucgaaaaacagccuauguaccagcucuggcaucugcucuacucguacgagagcgacaacucccgcaccgguaacgaaucacucuugagaaaacucgaaacuacuuucgguuucccagaagaauaugcaaccguccucugcgacguagucuucgaagaagacuacggcaaccuaucaguaaaagccaugcgcgaaauacuccccuaccuccaggccggaaacgacuacucccaagcaugcgcauacgccggauacaaucacucccgccacucacuaaccaaagaggaacuggaccaaaaaguuuacaaggaacgacucgaacuauuacccaaaaacucccuacgcaacccagucguagagaaaauccuaaaccaaaugaucaacgucauaaacgcgaucauagacgaguacggaaaacccgacgaaauccgaaucgaaauggccagggaacucaaaucaucugcggcagaccgaaagaaaacgacacacgcgaucucacaaggaaacgccgaaaaucaaagaaucagggagauccucgagaaagaguucuccuugucguacaucuccagaaacgauauaauuaaguacaaacuauacgaagaacucgaacccaauuauuauaaaacacucuauagugauacauauauaacaaaagacaaacuguucucaaaagacuucgacauugaacacaucaucccgaaagcuagacuauucgacgacuccuucuccaacaaaacccuagaggcccgcaacauaaaucuagaaaaguccaacaaaacagccuucgacuuuauuaaagagaaauacggggaagacggggcugaggcguacaaaaagaaacuggacaugcuguuagaaaacgacgcgauaagccgcccgaaauacaacaaccuccucagagcagaagccgacauccccagcgauuucauuaaccgcgaccuacgaaacacccaauacaucgccaagaaagccugcgagauucuuggagaauuagucaaaaccguuacaccgacaacgggcaaaauaacaaaccggcuccgcgaggacuggcaacuugucgacguaaugaaagaacuuaacuucgaaaaauacgaaaaacuggggcucaccgagaucguggaggaccgagacggccgaaaaaucaaacggauaaaagacuggacgaagagaaacgaucacagacaccacgccauggacgcacuagcaaucgccuucaccaagccuagcuucauccaguaccugaauaaccugaacgcccgcucaaauaaaggagacagcaucuacgcgauagaaaauaaagaacuccacuacgaagaggguaagcuccgauuuaacgccccuauucccguaaacgaguucagagccgaagccaaacgccaccucucagcgauacucguaaguauaaaagccaaaaacaaagugaugacacaaaauguuaacaagauaaagacuaagcacggcaucaucaaaaagauacagcucacaccacggggaccccuacacaacgagacaauuuacggaaccaagaugcgcccgauaauaaaaaugguaaagguaggugcagcacucgacgaggccaccauaaacaaagucagcucccccgccauucgggaggcacuucuaaagcggcuaaacgaauacagcgguaacgcgaagaaagcauucaccggcaaaaacacgcucgagaaaaaccccauauauuugaaugcaggucggaccaaaaccgugccgagccugguuaaaaccguggaaugggaaucauuccaccccaccagaaaacuaaucgacaaagaccuaaauguagacaagguggucgacaaggguauccgcgaaauccucaaggcgagacuugaagaguucaacggagaugccaaaaaggcguucagcaacuuagaagaaaacccaauauaucuggacgaagccaagaaaaucgcccuuaaacgaguaucgaucgaaggcguccuaucugcaauaccccuccacacacucaaaaaccaagccggcaaacccauaacgggaaaggacggaaaacccguacuaggcaacuacguccagaccuccaacaaccaccacaucgccuucuacuacgacgaggacgggaaccuccaagacaacgcgguuucauucuucgaggcagccgaacgaaagucacaaggcauacccgucaucgacaaagauuauaaccgcgauaaaggcuggcgcuuucuguucaccaugaaacagaacgaguacuucgucuucccgaacgaagccacaggguucauacccucugaaguagacuuaacagacgaagccaacuacggcauuauaucccccaacuuguaccgaguccaaaaagucaguagaaucgacaaaggaacaucggccucacgggacuacugguuccgacaccaccucgaaaccauacucaacgacgacgccaaacucaaaaaucuagcauucaagcgaauccgcggccuacuagaacucaaagauauuaucaaagucaggauaaacucgaccgggaaaauaguugccgucggagaauacgacuga

SEQ ID NO: 6683 - RNA, 4143 nt, Artificial Sequence
  Cas9 variant
augaagaaaauccucggccucgaccugggaaccacauccauaggcugggcccucgucaaugaggcagaaaccgaaagcgaaaagagcucgaucauacgccuggguguacgggucaacccccucaccaucgacgaaaaaggcaacuuugagaagggaaaagccaucacaacgaauagcgacagacagcaaagacacucugcacgcaucaaccuccagcguuacaagcugcgcagacaaaaccucugcgacugucugcaaaucgguggccugcucggguccgaaagcauguacgaagaaggaaaagaaagcaccuucgaaaccuauaaacuccgugcgaaagccgccaccgagaagguagcacuacacgaguucgcccgcauacucuucaugcugaacaagaaacguggauacaaaucaaaucgaaaagcaaacagcaaagaagauggccaggcauucgacggaaugaccaucgccaaaaagcuguacgaagagaaccucacgccagcagaguacucccuccaacuacuaaacaaaggcaagaaauucaguccgaguuacuacaggagcgaccucgaauccgaacucaaccggauaugggaggaacagaagaaauacuaccccgaaauccuaaccgacgacuucuaucagcaauuagaagggaaaaccaaaguuaacacaacuaaaaucuuccuagcaaaauacggaaucuacacagccgaccugaaagggcucgacaagaaaaugcagccgcucaaauggagaaucgaggcccuaaacaaacaaguagauaaagagguacuuacguucgucgucagugaccugaaaggccagauagagaaaacuagcggucuucucggggaaauaagcgaccgcagcaaagaacuauacuucaacaaacagacuguuggccaguacguaugggcgagccuaaaagaaaacccccacgucucaauaaagaacaaaccguucuaccgacaggacuaucucgacgaguucgagaaaauaugggaaacacaagccgcuuuucacaaggaacuaaccccggaacucaaaaaggaaauacgggacaucauaaucuucuaccagcgcccccucaagagcaagaaaggccucauuagcaucugcgaacucgaacaaaagaaagaaaaaguaaucauagaaggcaaagaaaaggaaauacuaaucggcucgaaaguggcccccaaaaguagucccauguaccaggaguucagaauauggcagaaccucaacaauguacuucucauagacacugaaauuaacgaaucccgcccccucgaugaggaagagaaggcacuauuguacaacgaacucucuguccgcgcgaaacugagcgaaacagaggcgcucaagacgaucaacaagaaaggcaagcacugggaccucaacuucaaagagcuagagggaaaccggacucaagccguccuauucgaaugcuauaaccggauaauaacccaaacaggccacgaagaaugcaacuucaagaaaaucagcgcggaagacauccgccacuacguggccaccauuuucaaaaaccugggcuucaacaccgacauacuagauuucaacccgagucuagaaaaacacgagcucgagaaacaacccauguaucaacuguggcacuuacuauacuccuacgaaagcgauaaaaguagaaccggcaaugaaagccuacucaacaaacucgaggcaaacuucgguuucccccaggaguaugccagcguacuagccgacgcgaccuucgaagacgacuacgggaacaucaguguaaaagccaucagaaaaauacucccccaccuacacgacggcuacgauuacagcgaagcgugcgagcgcgccggcuacaaccacagcguuaggagccugacaaaagaggagcucgcacaaaaggucuacaaagaccggcuagacuugcuccccaaaaacagcuuacgaaacccgguggucgagaagauacuaaaccagaugauaaacguaauuaacgcgaucauaguggaguacggcaagcccgacgaaauaagaauagaaauggcccgcgaacuaaaaucuucggccgcaaagcgcgaagaacgcacaaaauccauaaaccagaacgcagcggagaacaaaaggaucaccgaaauccuacaaacugaauuuggccucucauacauaucacggaacgacauagugaaauacaaauuauaccaggaacuggaggcaaacgguuucaaaacccuauacagcaacacguauauaccaaaagaaaagcuauucagcaaagacuucgacauagagcauauagucccaaaagccagacuauucgaugauuccuucgggaacaagaccaucgaagcccgagacguaaaccuagcgaaaucaaacaagaccgcauucgacuucgucaaagaaaaguacggggaacaaggcauagaagaauacaaaaagaaacuggauacacugcuaaaagagaacgccaucagcuccggcaaauauaagaagcuaaugaugagcgaggcagacaucccgucagacuucaucaaccgcgaccuaagaaacacccaauacaucgccaggaaggcauaugaaauccucggggaacucgugaagaccauaaccccaacaacgggaaagauaacugacaggcugcgggaagacuggcagcucauugacgucaugaaggagcugaacuucgaaaaauaugaccgccuaggccucaccgagguaauagaagaccgcgacggacgcaagauuaaacgaauaaaggacuggacgaagaggaaugaucacagacaucacgcuauggacgcccucaccauagccuucacgaaaccaucauacauccaguaccuaaacaaccuaaacgcacgcuccgacaaaucgggaucaauauaugcgauugaaacuaaagaacuccacagggaaaacaauacguugcgauucaacgcccccaugccccuaaacgaguucagaaaagaagccaaacgccaccucagcgcaauccuggucuccauaaaagcgaaaaauaaagucaugacccaaaacgucaacaaaauaaaaaccaaaaacgggauaauuaagaaaguccaauuaacaccacgcggggcacuccauaacgaaacaaucuacgggaccaaaaugcggccgauaaucaagaugguaaaaaucggggcagcacuagacgaagcgacaauaaacaaaguaucaagccccacaauccgugaagcccugcuaaaacgccucaaugaauacucaggcgacgcuaaaaaggcauucgcgggcaagaacgccaucaccaaaaaucccauauaccuaaacgcggagcacacaaagaccgccccugcaauggugaaaaucgucgagugggagauguacuaccccauccgaaaacucauaacaccagaccuaaagauagaaaaagucaucgacaauggcauaaaagagauccucaagaaacgcuugaaagaguucggcggagacgccaaaaaggccuucucuaaucuggaugaaugcccaauuuaccuagacgaagaaaagaacaucacguuaaaacgcguaucaauagaagggguccucagcgcaaucccaguacauacucucaaaaaccacgcaggaaaagaaauaaaagaugaggauggaaaagccguacucggcgauuacguacaaacaagcaacaaccaccacguggcaaucuaccaagacgcaaagggaaaccuacaagacaauguaauauccuucuucgaagcagcagagcgaaagucccaaaacguccccaucguugacaaaaaccucaauagagacaaaggcuggcacuuccucuacaccaugaaacagaaugaauacuucguauucccgaaugaggaaaccggauucgucccuucagaaauagaucuaauggacgaaaacaauuacgagaugauaucccccaaccuguuccgaguccaaacaaugucccgggucgacuacggaaaaacaaucaucagagaguacgucuuccgcaaccaucuggagaccauccucaacgacaaccucaaacuaaaaggucuagucuucaagaaaaucaaaagccugaaagcccuagaaggcauagucaaaguucggguaaaugccaucggcaaaaucgucgcggucggagaguaugacuga

SEQ ID NO: 6684 - RNA, 4143 nt, Artificial Sequence
  Cas9 variant
augaagaagaaauacgccauuggaauagacaucggcacaaacuccgucggcuggagcgucgucaccgaugacuacaaaguccccucgaaaaagaugaaagucuucggcaauaccgaaaagcgauacaucaaaaagaaccuccuuggaacccuauuguucgacgaaggaaacaccgcggaaaaccgccgccucaagcgcaccgcacgacgccgguacacgcggagacgcaaccgcauauuauaccuacaagaaauauucgccgaagaaauaaacaagauagacgacagcuucuuucagcgccucgacgacagcuuccucauaguugaagacaaacaggggagcaaacacccaaucuuuggcacacuacaagaggagaaagaauaucacaaacaauucccuaccaucuaccaccuucggaagcagcuggcagacucgagccagaaagccgacauccgacucaucuaccuggcccuugcccauauaauaaaguaccgaggccacuuccuauucgagggcgaccucaaaucagaaaauaaagacguccagcacuuauucaacgacuuuguugagauguucgacaaaaccgucgagggcuccuaccuauccgaaaaccuuccaaauguggccgacguccuaguagaaaaggugagcaaauccagacaccuagagaacauacuucacuacuuccccaacgaaaagaaaaacggccuauucggaaauuuccuagcacuggcccucgggcuacaaccaaauuucaaaaccaacuucgaacuagccgaggacgccaaaauccaguucagcaaagagacauacgaggaagaccuugaagaacuacucgguaaaaucggugaugacuacgcagaccuuuuuauugccacgaagucacuguacgacgguauacucuuggccgggauucucucuacaaccaauucuaccacuaaagcgccgcuuagcuccucaauggucaaccguuacgaggaacaccagaaggaucucgcgcuccucaaaaacuucauccaccagaaccuaucagauucauauaaagaaguauucaacgacaaguuaaaggauggguacgcaggcuauauugaagggaagacaacacaggagaacuucuacagguuuauaaagaaagccaucgaaaagauugacggcucgaacuacuucaucgagaaaaucgaacgcgaagacuuccuccgaaaacaacgcacguuugacaacggguccauuccccaccaaauccaccuccgagagaugcaggcuaucauacgaagacaggccaaauuuuaccccuuucuagaagaaaaccaggacaagaucgagaaaauacugacauuccggauuccauacuacguaggaccccuugcccgagguaaguccgaauuugcguggcuaaauaggaaaagcgacgagaaaauccgccccuggaacuucgacgaaauggucgacaaggaaacauccgcagagaacuucaucacgcgcaugacaaacuacgaccaauaucucccggaucaaaagguccuuccgaagcacagccuccucuacgagaaauucgcugucuauaacgagcucacaaaagucagguacgucacagaacagggcaaauccuucuucuucgacgcaaauaugaaacaagaaaucuucgaccgcaccuuuaaaguauaucgcaaagugacaaaggagaaacugauggacuuccuaagcaaagaguucgacgaguuccggauuguggaccuccugggccuugacaaagacaacaaauccuucaacgccucucuagggaccuaccacgacuuaaagaaaauagucucugaagacuuccucgacaacagcgaaaacgaagauauccuugaaaacguaguccuuacgcucaccuuauucgaagacagagaaaugaucaggaaaagguuagaaaaauacaaagacgugcucacagaggaacagaggaaaaagcuagaacgcagacacuacaccggauggggccgacucagcgccaaacucauaaacggaauacgagacaaaguuacacgcaaaacaauccuagacuaccucauagaugacggaacaagcaaccggaacuucaugcagcucauaaacgacgacacccuaucguucguagacgagaucagauuagcucaaggaagcggaaaagccgaggacuaccgggcagaaguccagaacuuagccggaucccccgccaucaagaaaggcauacuccagucacucaaaaucgucgacgaacuaauugaagucaugggauacgacccagagcacaucgucguagagauggcacgggaaaaucaguucacaaaccaagggcgaagaaacucccagcaacgcuacaagaaaaucgaaaacgccaucaaaaaccucgacuccaaccugaacagcaaaauuuugaaggaauacccgaccaacaaccaggcccuacagaaugaccgccucuuucuauacuaccuucaaaacgguaaagacauguacaccgaugaagaacucgacaucgaccagcugagccaauacgacaucgaccacaucaucccacaagcauucauuaaagacgacucacucgacaacaaagugcucacaaaauccgcaaagaaccgcggaaaaagcgacgacguccccucccuagaaauaguauauaaaaagaaaaacuucuggaagcaacuccucgauagccaacucaucucgcaacggaaguucgacaaccucacaaaagcagagcguggcggauuaacgaacgaagacaaagcccgauucauccagcgccagcugguugaaacgcgccaaauaacaaaacacgucgcacgaauccuggacacucgcuucaacaccaaacucgacgaagccggcaaccgaauccgugaccccaaagucaacauuaugacccucaaguccagccucgucagccaauuccguaaagauuaccaguuauacaagguacgggagaucaauaacuaccaccacgcgcacgacgccuaccugaacgcagucgucgcaacagcgcuccucaagaaguacccacaacuggcuccugaguucguguauggcgacuaccccaaauacaacuccuacaaaucgcgaaaaagcgcaaccgaaaaaguacucuucuacucaaacaucaugaacuucuuuaagcgcguacucgucuacuccaaaacuggggaaguuaggauucggccugucaucgaagucaacaaggaaaccggagagaucgugugggacaaaaaguccgauuuccgcaccguccgcaaaguccucagcuacccccaaguaaacgucguuaagaagaccgaaguacaaaaccacgggcuggacagaggcaagccaaagggguucuacaacgcaaaccugucgccccgaccgaaagagggcucagucgaaaacuuaguacccgccaaacaguccuucgacacaaaaagauacggcgguuacgccgggaucuccaacagcuaugcggugcucgucaacggaaucaucgaaaaaggcaaaaagaaaucaaaagcggaggugaccgaguuucaaggcauuagcauucucgcgcgcaaagacuuugauaaaaaccccaagcaauaccuccucaaccucgguuacaaggacaucaaaaguauaauuaagcuaccaaaauacagccucuucgagcucgagaauggaucacgccggaugcucgcaucaauccucucaacgaauaacaaaagaggcgagauccacaaaggaaacgaaauguaccugccagauaaauuugugacccuucuauaccaugcaaugcgggugaauagaacccucgagccuggccacaagaaauacguagaagcacaccgccaugucuucgacgaacuacuuaccuacauccucgaguacaacgaaaagauaguaggagccaaggcuaacggcaaacgaauuguagaagccuacagcgcccgaaaggacaccgacaaccuugaggaacuguguaacuccuuuaucaaucuccucaaccuaacagcacucgggucagcaguagacuucgaguuccuaggcacaaagauaccacgcuaccgagacuacacaccaagcagccuccucaaagcaacccucauacaccaguccgucaccggacuauacgaaacgcgcauugaucucagcaaacuaggcggggacuga

SEQ ID NO: 6685 - RNA, 4143 nt, Artificial Sequence
  Cas9 variant
augaagaaaauccuaggccucgaccuagguacaaccagcaucggcugggcccuugucuaugaaucggaaaacgccgaugagaaaagcagcaucguccgccucggcguaagaguaaacccacucagcguggaugaaaaaggcaacuucgaaaagggcaagaguauaacgacaaacgccgaccgccagcaaacacauggcgcgcgcaucaaccuacagcgauacaaauugcgcagagaaaacuugaaggacugccugcagaagcaggguuggaucgggaccgaagcccuguacgaagaaggaaaaacguccacguucgagacauacaugcugagagccaaagccgcggaagaagagaucucacugcacgagcuaugccgaguacuguucaugcuaaacaagaaaagaggauacaaaagcaaccgcaaagccaacaacaaggaggacggaaagcuauucgacggaaugacuguagccaaaaagcucuacgaggaacaucugacccccgcagaguacucccuaaagcugcugagcaguggcaagaaguucaagcaagaguauuaccgguccgaucucaaagaagaguucgauagaauauggaacgaacaacaaaaauacuacccagaaauccucaccgacgacuuuaaacaacaacuucagggcaaaucgaaagguaacaccagcaagaucuuucucgguaaauacggaauauauagcgcagaccuuaaaggacuagaccgcaaacuccaaccccuaaaauggcgcguggaagcccugaaacaaaaaguagacaaggaaguccuggccuucgucaucucugaccuaaacgggcagauugccaguacgucugggcuccucggggccaucagugacagaagcaaggaacucuacuucaacaagcaaacgguuggccaauaccuauggaccagccuaaaggaaagcccacacgucaguauuaagaauaaaccauucuaucgccaagauuacuuggacgaguucgagaaaauaugggaaacacaggccacguaccacaaagaacucaccccggaacucaagcaagagauccgcgacauaauaauauucuaccagcgcccacucaaauccaagaaaggacuuauuagcgugugcgagcuggagcaacgcaaagucaaggucaccaucgacgggaaagagaaggaaaucuccaucgggccaaaggucgcaccgaaaucuuccccgauguuccaggaguuccgaauuuggcaaaauuuaaacaacauccuauuaaucgacaaagguaacaacagcaaucgaccacuauacgaagaagaacggaaccuccuguacgaagaacuuaguguuaaagaaaaacuuucuaaggcagaagcucucaaaguccucaauaaaaacggaaaacaaugggacuuaaauuacaaagagaucgagggcaaucguacccaagccguacucuacgacugcuacaaccgaaucaucgggaugaccggccaugaagaaugcaacuucaagaaacucaaagccagcgacauaagauacaacgugaagacgaucuucaaaaaccuagguuucuccacagacauacuagacuucgauaguagccugcagggccacgagcuugagcgacaacccuccuaccaacucuggcaucugcuauacaguuacgaguccgacaacagcagaacaggcaaugacgcccugcuccgcaaacuggaaacggccuucagcaucccaaaagaauacgcugcugugcucagcgacgucguguucgaggacuccuacgguaaccucagcgugaaagcaaugcgaaacauccucccgcaucugcaagcaggcuuagacuacagccaagccugugaaaaagcaggauauaaacacagcaggaggucacucaccaagaacgagcuugauaagaaagaguacaaagagaaacuggaacuacuaccgaagucuagccuacacaauccggucguagagaaaauccuaaaccaaaugaucaacgugaucaacgccgucauugacgaauacggaaaacccgacgaaauacgcauagaacuagcccgcgagcuaaaaaucggggccgccgagcgggaaaacaugacaagaucaauaaaucagggaaacgcagaaaacaaacggauucgcgaaauacucgaaaaggaguucgcucucagcuacaucagucgaaacgacaucauaaaauauaaacuuuacgaagaacucaaauccaacggguucaaaacccuauacuccgacaccuacauaaguaaggacaagcuauucagcaaagacuucgacauagaacacaucaucccaaaagcgcgacucuucgacgacagccucuccaacaaaacuauagaggcacgggacguaaacaucgcaaaaagcaauaagacagcguuugauuucaucucagaaaaguacgaucaacaaggaaucgaagcauacaagaagaaacucgacauacuccuacaagacgggucuaucucuaaagcuaaauacaaccgccuucuaaugaaggaggccgauauuccaagcggguucaucgacagggaucuccgagacacacaauacaucgcgaagaaagccuacgagauccucagcgaucucgugagaaacgucacgccgaccaccggggccgucaccucucgacuucgagaagacuggcagcuaguagacgucaugaaagaacucaacuucgaaaaauaccaaaaacuagggcuaguagaggucauagaagaccgagacggccgaaagauaaaacgaaucaaagauuggacaaagcgcaacgaccacagacaccacgcaauggacgcccucacgaucgccuucacuaaaccguccuacauucaauaccucaacaaucuaaacgcacgcuccgauaagaauagcucgauauacggaauagaaaacaaagaacuccaccgagaggacaacaaacuacgauucaacgcaccccuccccaucaacgaguucagagccgaagcccgccgccaucugaaaagcauacucguuagcgucaaagccaaaaacaagguaaugacucaaaacgucaacgucauaaaaaccaaacacggggucaucaaaaagguccaacugacgccccgcggcgaacugcacaacgccacauuuuacggaaccaaaaagcgccccaucaucaaaauggucaaggucggcgcagcacucgacgaagucacaauuaaaaaggucagcagcuccuuuauccgggaagcgcuccuagaccgacuucacgaauacaacggggacgccaaaaaggccuucacgggccggaacucgauagauaaaaauccaauauacaucgacgaagaacacaaaaagaccgugccggcucuagucaagacgauagaaugggaaauguaccacccaacgcggaaaaugaucucacccgaccucaagaucgauaaaguaauugacaagggaauuagggagauacuacgaacccgacuagcgaaauucaacggagacgcgcaaaaagcauucagcaaccucgacgaaaacccuauuuacaaagacgaagcaaagaagaucacacugaaacgaguaucacuagaaggaguaagcagcgucaucccacuucacaaacuaaaggacaugggaggaaaaccgguaguuggcaaagauggcaagccagucuggggagacuacguacagacaagcaacaaccaccacaucgcguucuacauggacgagaacggcaaccugcaagaugacguaguaaccuucuucaaagcagcaaggcgaaaaagccagggggucccggucauagacaaaaauuacaaccaugacaaaggcuggcacuuccuguucaccaugaaacaaaacgaguacuucguauuucccaacgaagccaccggguucauccccacggagguagaccucauggaugaagccaacuacgacaugauaucccccaacuuauaccgagugcaaaagauguccaagacgaagcaggggaucacggacaaaagggacuacugguucagacaccaccucgagacagugcuaaacaacgaccucaaggugagaaauuccauauucaaacagaucaacagucucaaaccccucgagggaauagucaaggugagaaucaaugcuauaggaaaaaucgucgcaaucggcgaauacgacuga

SEQ ID NO: 6686 - RNA, 4143 nt, Artificial Sequence
  Cas9 variant
augaaacgcauucuaggccuggaccugggcacgacaucuaucggcugggccuuggugaacgaagccgaaucuaacaacgaggcaagcagcaucguccgacucgggguccgagucaacccccuuacaguugaugaaaaauccaacuucgaaaaaggcaaggcaaucacaacaaacgcagacagacaauugaggcauggagccagaaucaaccugcaaagguacaaacuccgacgucagaaccuccacgacugccuacagaaacaaggcuggcucgggacggaagcaauguacgaggagggcaaagcaaguacauucgaaaccuacaaacuacgagccaaggccgcugaagaagaaauaagccuccacgaguucgcccggguccuauucaugcucaacaagaagagaggauacaaaagcaaccgcaaagccaacaacaaagaggacggacagcuguucgauggcaugacaauagccaagaaacuauacgaggaacaccugacuccagcagaauacucacuacagcuccugaacaaggguaagaaauuuacccagggcuacuaccgcagcgaccucaacgcugaacuggaacgcauaugggacgaacagaaaaaguacuacccggaaauccucacugacgaguucaaacaacaacuagaaggaaagaccaagacgaacacaucaaagaucuuccuggcgaaauacggaaucuacuccgccgaccuaaaggggcuugaccgcaagcuccagccacugaaauggcgcguagaagcacucaaacaacagguggacaaagaaguguuagcauuuguuauaagcgacuuaaagggccaaauugcaaacacauccggccugcugggcgcgauauccgaccgcagcaaagaacuuuacuucaauaaacaaacagugggacaguaccucugggccucccuagaagagaacccgcauauaucaaucaagaauaaacccuucuaccgccaggacuacuuagacgaauuugaaaagauaugggagacucaggccacguuccacaagcaacugacccccgaacuuaagcaagagaucagggauauaaucauauuuuaccaacggccacucaaaagcaagaaaagccuuaucuccguaugcgaacuagaacaaaggaaaguaaaggcaaccaucgacggaaaagagaaagaaaucaccaucggcccgaaaguugcuccaaaaucaagcccuguguuccaggaguuccgcaucuggcagaaccuaaacaacguacuccucauagacaacgacaccaacgaaaaacggccccuagacgaagacgaacgcuaccuccuuuacaaagagcuguccaucaaagcgaaauuauccaaaacggaagcucuuaagauccugaacaagaaaggcaaacagugggacuugaacuacaaagagcuagaaggaaacaggacucaagccauacuauucgacugcuacaaccgcauuaucacccucacuggccacgaagaaugcgacuucaagaaaaucaaagccucggagauccgccacuacguauccacgaucuucaaaaaccugggguucagcaccgaaauccuggacuucgacccaagccucgaaaaacacgagcuagaaaagcaacccauguaccaacucuggcaccuucuauacuccuaugagagcgauaacucacguacaggcaacgaaucuuuacuccgcaaacucgaaaccacauucggauuccccgaagaauaugccacgguacucugcgaugugguguucgaagaggauuauggaaaccuaucaguuaaggccaugcgaaaaauccuccccuaccuccaggcgggcaacgacuacucacaagcaugcgccuacgcgggauacaaucacucgcggcacucacuaaccaaggaggaacuagaccagaaaguuuacaaagaaagacuagagcuccucccgaagaacucccuacgaaacccagucguagagaaaauauugaaccagaugauaaacgugaucaacgccaucaucgacgaauacgguaaaccugacgaaauaagaaucgaaauggcccgugaacucaaaagcagcgccgcagaucggaagaaaaccacacaugcaaucaaccagggaaacgacgaaaaccaaugcauccgcgaaaucuuagaaaaagaguucgcccucaguuacaucucgcggaacgacauaauuaaauacaaacucuacgaggaacucaaaccuaacggguucaaaacccucuacucggauaccuacauacccaaagauaaacucuucagcaaagacuucgacaucgaacacaucauuccgaaagcccgccuauucgacgauuccuacucgaacaaaacuuuggaggcccgagacauaaaucuagcaaaaucaaacaagacagccuucgacuucguuaaagaaaaauacggcgagcaaggcgccgaagccuacaagaagaaacuugacaugcugcucgggaacaacgucaucuccaaaccgaaauacaacaaacugcucaugaccgaggccgacaucccgagugacuuuauaaaccgagaccuaagaaacacacaauacauagcccgcaaggcgugcgaaauucuaggagaacucguccguacagucacacccaccaccgguaagaucacuaauagacuccgcgaagacuggcaacucguagacguaaugaaggaacucaacuucgagaaauacgaaaaacugggucucaccgaaaucgucgaagaccgcgacggccgcaaaaucaagcgcauaaaagacuggacuaagcgcaaugaucaccggcaccacgcaauggaugcacuagccaucgccuucacaaaacccucauauauccaauaccugaacaaccuaaaugcccggucaaacaagggugacucaaucuacgcuaucgagaacaaagaacuacacuacgaagagggaaaacuccgcuuuaacgcgcccauccccgugaacguauuccgugccgaagcaaagcgccaccugucagcgauccuugucuccaucaaagcaaagaacaaggugaugacccagaacguaaacaaaauuaagacaaaacacgggaucaucaagaaaauucagcucaccccucggggcccccuccacaacgaaacaaucuacggcaccaaaaugcggccaaucaucaagaaagucaaaguuggugcagcucuagacgaggcaacaauuaacaaagucuccucgcccgcaauccgcgaaguacuccuaaaacggcuaaacgaauauucaggaaaugcgaaaaaggcauucacgggcaaaaacacgcucgauaaaaaccccaucuaucugaacgccgaacgcaccaagacugugcccgccucaguaaaaaccgucgaaugggaaaacuaccauccaaucagaaaacccauaaccccagaucucaaaguggauaagguaauagauaagggaauaggagaaauucugaaggcgcgccucgaggaguucaacggggacgccaagaaagcauucucgaaccuagaagaaaacccuauauaucucgaccagacaaagaaaaucgcccucaaacgagucuccaucgaagggguccuuucaacgauacccuuacauacccugaaaaaccaagcagggaaaccaauaaugggcaaagauggcaaaccaguccuagggaacuauguacaaaccuccaauaaucaccacaucgcguucuacuacgacgaggacggaaaccuccaagacaacgccguaucauucuucgaggccgcugaacguaaaucacaaggcaucagcguaaucgacaaagacuacaaccgagacaaaggauggcgcuuccucuuuacaaugaaacaaaaugaauacuucguauucccaaacgaggccacaggcuucauaccuagcgagguagaccugacagacgaagccaacuauggcaucauaagcccgaaccuguaccgcguccagaagauguccaggauagagaagggcacgagcgucucgagagacuacugguuccgacaccacuuggaaaccauacuaaacgaugacagccgccucaagaacuccgccuuuaaacgcauuaauucucucaaaccccuggagggcaucaucaaagugcguaucaacuccaucgggaaaaucguagcgguuggcgaauacgacuga

SEQ ID NO: 6687 - RNA, 4143 nt, Artificial Sequence
  Cas9 variant
augaaaaagggguacucaaucgggcuugacauaggaacaaauuccguaggauucgccgucauaaccgacgacuacaaaguccccuccaagaaaaugaaaguccucgggaacacggauaaacgcuucaucaaaaagaaucucauaggggcccuucuauucgacgaaggaacaacagcagaagcgaggcgucucaaacgcacagcaagacgacgauacacacguaggaagaaccggcuaagguaccuccaggaaaucuuuucagaagaaaugagcaaagucgacagcuccuuuuuccaccgucucgacgacucauuucuaauacccgaagacaaacgggaauccaaauacccaaucuuugccacccucgaagaggaaaaagaauaccauaaaaaguucccaaccaucuaucaccuccgcaaacaccuagccgacuccaaggaaaaagcagaccugagacuaauauaccuagcccuggcacacaugauaaaauaccgaggccacuuccuauacgaagacacguucgacaucaaaaacaacgacauacagaaaaucuucaacgaguucauauccauauacgacaacgccuuugagggcucaucacuuucuggccaaaacgcgcaaguagaagcaauauuuaccgacaaaaucuccaaaagcgccaagagagagcgcguacucaaacucuuccccgacgagaaauccacggggcuauucuccgaguuccucaaacugaucgucggcaaccaagccgauuuuaagaagcacuucgaccuggaagacaaagcaccccuucaauucucgaaggacacuuacgacgaagaccucgaaaaccuccucggccaaauaggggacgauuuugcggaucuauucguagcugcuaagaaacuauacgacgccauucugcuuucggguauacugaccgucaccgaccccucaacaaaagcaccccuauccgcaucaaugaucgaacgguacgaaaaccaccaaaaugaccucgucguauugaaacaauucauaaagaacaaccucccagagaauuacgucgaagucuucuccgacgacagcaaaaacggauacgcaggauauguaggcgucgacucaaagauccgaaaacgcaaugcgaaacuagccaccgaggaagaguucuacaaauaccucaaaaauauacucaacaacguaaaaggcgcagacuacuuccucgacaaaaucgagcgcgaagacuuucuccgcaaacaacgcaccuuugacaacggcuccaucccacaccaaauacaccuacaagaaaugaacgcgauucugcgccggcaaggggagcacuaccccuucuugaaagaaaaccgagagaaaaucgagaaaauccucaccuuccguauaccauacuacgucggcccucuugcacgcggcaaccgggacuucgcauggcugacgcggaacucugaccaagccauacgcccauggaacuucgaggaaaucguagacaaagccuccucugcagaggacuucauaaacaagaugaccaacuacgaucucuaccuaccagaggagaagguacucccaaagcauagucuacuguacgaaaaauucgccguauacaacgaacucacgaagguuaaauucaucgccgaaggcuugcgggacuaucaauuccuggacucaggacagaagaagcagaucgugaaucaauuauucaaagagaaaagaaaagugacggaaaaagacaucauccacuacuugcacaccguagacggcuacgaugggaucgagcucaaaggcauugagaaacaauucaacgcaagccucucuaccuaucacgaucuacugaaaaucaucaaggacaaagaguucauggaugaccccaagaacgaagaaauccuagaaaacaucguccauacccugaccauauuugaagaccgcgagaugauaaagcaaaggcucgcucaauacgacucccucuucgacgaaaaagucaucaagucacucacccgacgacacuacacgggcugggggaaacuaagcgcgaugcuaaucaacgggaucagagacaaacaaaccggcaagacuauccucgacuaccucauagacgacgcauacuacaaccgcaauuuuaugcaacuaaucaacgacgacggacugagcuucaaagaaaucauacaaaaagcacaagugguaggcaaaaccgacgacgucaaacaagucguacaagagcuacccggcagccccgcaaucaagaaagguaucuuacaaucgauaaaaaucgucgacgaacucguaaaaaucaugaggcacaauccagaauccauaguuaucgaaauggcccgagaaaaccaaacaacagcccgaggaaagaaaaacucacaacaacgguacaaacgaaucgaagacgcccucaaaaaccuagcccccgggcuagacagcaauauccuaaaagaacacccgaccgauaacguccagcuccaaaaugaccgucucuuccuuuacuaccuacagaacggcaaagauauguauacgggcgaagcacuggauaucaaccagcucucaucuuacgacauagaccacauaauaccacaagccuucauaaaagaugacagcuucgacaaccggguacucacaucauccaaagacaaccggggcaaaagcgacaacgucccauccauagaggucguccagaaaaggaaggccuucuggcaacagcugcuagacagcaagcuaaucucggaacgcaaauucaauaacuuaaccaaagcggaacgcgggggccucgacgagcgagacaaagucggcuucauuaaacgccaguuaguugagaccagacaaauuaccaaacacguugcacaaauccuagacgcccgguacaauacggaagugaaugaaaaagacaagaaaaauaggacuguuaaaaucauaacacuaaaaagcaaccuugucucaaacuuccgaaaggaguuucgccuauauaaaguacgggagaucaaugacuaccaccacgcccacgacgcauaccucaacgcagucguagcuaaggccauacuaaagaaauaccccaaacucgagccagaguucguauauggagaauaccagaaauacgaucugaagcgauacaucucgaggagcaaagaccccaaggaagucgagaaagcaacggagaaauacuucuucuacagcaaucuucucaauuucuuuaaggaagaagugcacuacgccgacggcaccauaguaaagagggagaacaucgaguacucuaaagacacgggagaaaucgcauggaacaaggagaaggauuucgccaucaucaagaaaguacuaucccucccccaggucaacaucgugaagaaacgugaaguacaaaccggaggcuucuccaaagaaagcauucuucccaaaggcaacucagacaaacuaaucccgcgaaaaaccaaagacauccuaugggacaccaccaaauacggcggcuuugacucaccagucaucgcauacucaauccugcucauugccgacaucgagaaaggaaaggccaagaaacuaaaaacuguaaaaacccucgucggaauuaccauuauggagaaggcggcguucgaagacaauccaauaacuuuucuggaaaacaaagguuaucauaacguccgaaaagagaacauacuaugucuucccaaauauagccuauucgaacuggaaaaugggcgacgccggcuacuugcaagcgccaaggagcuccagaaaggcaacgaaaucguucuccccguuuaccuaacuacgcuccucuaucacuccaagaacguccacaaacuagaugaacccggacaccuggaauacauacaaaagcaccggaacgaguucaaagacuugcuaaaccucguguccgaguucucgcaaaaauacguccucgcagacgccaaccuagagaaaaucaaaucccucuacgccgacaacgaacaggccgacaucgaaauccucgccaauucguucauuaaccuccuaaccuucacagcccucggagcccccgcggcauucaaauuuuucggcaaggacaucgaccggaagcgcuacaccacagucagcgaaaucuuaaacgcaacucuaauacaccaguccaucaccgggcuauacgaaacaagaaucgaccuauccaagcugggcgaagacuga

SEQ ID NO: 6688 - RNA, 4143 nt, Artificial Sequence
  Cas9 variant
augaaccucagacauguuggcaacuacaacauaggccuagacaugggcacagcaagcgugggcugggcagccaucgacgaacaaggcgagcugcuucacuucaaaggcaaaccaacguggggcagccggcuauucgacuccgcaaacaccgccgcaacugcaagaaugccucggggccaacgucggagauacauccgacgcagauggcgacuagaccucuuacaaaaguucuucagcgaggaaauggcggaaaaggacccggaguucuucauccgucuacggcaauccagccuguggccugaggaccgcgagggcggacacacagcguaccacuggccacuauuuaaugacucggacuuuaacgaaaaagaguacuacgaaaaauuuccaacaauauuccaccuuaggcaauggcuaauggaaacugacgaaaaggcggacauacgccuaaucuacuuggccuuccacaacauaguaaaacacaggggcaacuuucuacaagagaacaacgacagccuuuccgcacaaaacgcgaacaugcgggagagccuagagucauucugcauagcgcuagaagaauggugcgacgaaaaagagcugacgugcagcugcgacccccagaaguuggaacaucucuuuaaggagguaaaauaccgcucggacauccgcgacggcuucgcagcacugcuaggucucgcgugcuccggcgaaaacgaaguagacgugaaggcgauggcgaaagaaaugggcaaagccauagucgguuacaaagcggacuucagcaagaucuucaccgagugcgacaaggaaggauccagcuuccgccuaucagacgacgagggcccugaagcguuccuagacauaugcccagacgacggaauagcccuguucgaagccauacagauggucuacagcucauucauccuuaccggaaugcuaacggaaaaaggucuaagccugagcaaaauaagcgccuacaaccaauacggacaggaccucgaaagccucaaagcccuaguaaaagaguacguacccaacgaauauagcucauuuuucagggguccaacauacucaggaagcacagaauacgaccccucaaaagcgcaaggcuacacgcgcuacaaccucggcccauccaagaaaggcucaggcgcgaagccaauggcauacgaggacuucaagaaaucagucgaacagcuguucgcaaacacuaacgcaaucaaugacgagcgguacaaagaaaugaugggacgauucgcggaagagaaauuucuccgacgacuacguacuagcgacaacggacgcauacccuuccaacuaaaccucgaggaaaugacagccauaaucaucaaccagggcaaguacuaccccuuuuuacuggaacaacaagaaaaacuggaaagccucguacgauuccguauaccuuacuacguggguccccucacgcgaaucaacgcgcggcucgauucgaaagguaacgcaugcuucgccuggagcaaaaggaaagauggaauggacucugcgagcaucaaaccguggaacugggacgaagucaucgacaagcacgcauccgcucaggcuuucauagagcguaugaccggaaccugcaccuaccugcgaggcgaacccguucucccgcgauguucccuacuuuacgaagaauacugcguccugaacgaacucaauggagcccgcuggacacaggacggugacaaauucauacgauucgacuacaaagaccgcucagacauaaucgaagaacucuucaagaaacgacgagggcggauccaauacgccgcaguggccgacuggaugaagcaagaaagaucacacgccaacguccauguuagugggggacagggcgaaaaugcguucgagagccgacugucuagcuaccacuucuucugcaacgacgucuucggaguagacgaacuuccgggaucguacguggauauggucgaagaaauaauucuguggucgacccuguucgaagaccgcagcauccuaagggaagaaauccaacguaaguacggggauguucucaacgaagaacagaucaaaacaaucugcaagaaacgauucagugggugggggcgacuuagccgcaaacuuuuaugcagccucaaagcccagaccgacaacggccccaaaagcaucauggacauacuccaagaaggcgaccaaaacaacggacgcgugggccgagcaauggucuuccaagagauucuccaugacgaacaacucggcuucgaacagaaaaucgaggaggaaaacacccaaucgaugcuggaaggggaaaaccuacuaauagaagaccuaccuggcagcccugcgauccgccgaucgauaaaucaagcaguuagaaucgucgacgagauaguagggaucgccggacacgcgcccgauaacauauucauagagguaacuagggaggacgacaccaaaaagaaaggcaaacgaaccacaaccagauacucgaauauccagaaagcacuggaagcgcugaaagaagagggcgcggaagcccucagagaacucaaaacauacaaacacaacgagcucgauaagcgccugucacuauacuucaugcagaacggcaaaucgcucuacucaggaauaccauuagauauacggagauuauccgaguaccagauagaccacauaauaccgcaaucguauaucaaagacgacagcuacgaaaacauggcccuagugcuacccggcgaaaaccaaucgaaagcagacaaccuacuaaucucacaagacauccggaucaagaugaaagcaacuuggacggcacuucacaaagcaggauugaugggcgauaagaaauacaacaaccugaugaacucaaguaucucagaugcaaaaaugaaaggcuucaucaaccggcagcucguggaaaccucgcagagcgucaaacuaacacaaaugaugcucagucagaaauauccaggcgccaagguccgacccaucaaggccucaauaucaucccaacuacgcgacgcaugcgaccuaguaaaaugucgggaagccaacgacuaccaccacgcacacgacgcauaccuugcaugccaagucggaagauucguacugaaacggcauucaagcauguucgacaacccaauaggaaugacaaaaguaauccgcgacuucgugaaacggcaaggucaggaguucaagagaaacgguaaacuuccagccuacgcgagcagaucagguuucauaguccagagcuucaugcgaucgggauucgacgcagaaacaggggaacuacuccgagacgacuggaacgcacccuuugaaauagcacguauaaaacgaugccuaaacuacagagauugcuacauaucccguaugccaauggaggacucaggagcguucugggacgccacgauauacuccccgaaagccggcaagaaaggagcccucccagugaaacaggggcuccccguggagaaguacggcuccuacuccagagaacaauuugcguacuucuucguuuacaaggccuacaacccaaagaagaaagccuaccgccuggaguucgaagcggugcccguccgcguagcaagcgcggucgaaacacgcgaaaacgcccuagaagaguaugcaaaaucuguggcaaaacaagcaggcuuggaguucgucgaagucgcccgcccgaaaguauacaaauaucaacugauagaacuaggggaagaccgccuguauaucaccgggaagcgcgaaguaagaaacgcaagucaacuggccuucucgcucgacgaaauagaccuacuuaaacggcuagccgagggcgaagagacaagcucugaggagcgcgaacgccuauucgacguacuaauagagaaauacgcgagauacgcaccacgacucgcccgacaacucuccgucgacagcaugucagcgacauuugaaacacucaacgccgaagaacagcuaggcauacuauuaucccucguggaaauagcuaauggaaaacgcaacaugauagaccucucguccgccggcggcagcaaaaaugcggggugcaugaacccaacauuuucaucggagcuaucaagcccaggaaguaauuucacauucauagaccagagcgugaccgguauguucgagagacgacaacgccuggaacucuga

SEQ ID NO: 6689 - RNA, 4146 nt, Artificial Sequence
  Cas9 variant
augguaaagaaaaaguaugccaucggaauagauauaggaaccaacucugucggcugguccauagucaccgacgacuacaaaguacccuccaagaaaaugaaaguguucggcaacaccgaaaaacgcuacauaaagaaaaaccuacuaggaacguuacucuucgacgagggcaacaccgccgagaaccggcgccugaaaagaaccgcacgccgacgguauacacgccgacgcaaccgcauucucuaccuccaagagauuuucgccgaagaaauaaacaaaauagacgacucuuucuuccaacgccuggacgacuccuuccuaaucguugaagauaaacagggcuccaaacacccaauauucggcacccuucaggaagagaaagaauaccacaagcaauuccccaccauauaucaccuacggaaacaacucgccgacagcagccaaaaggcggacauacgccucaucuaccucgcccuugcacauaucauaaaguaccgagggcacuucuuauucgagggagaccuaaagucagaaaacaaggacguccaacaccuauucaaugacuucguggagauguucgacaaaacugucgagggguccuaccuaagcgaaaaucucccaaacgucgcagauguccuaguagaaaaagucuccaaaagccggcgguuagagaacauccuucacuacuucccaaacgaaaagaaaaauggccucuucggaaacuuucucgcccuagcacugggacugcagcccaacuucaaaaccaauuucgaguuagcagaagacgccaaaauacaauuuagcaaagagaccuacgaagaagaccuggaggaacuccuugguaaaaucggagacgacuacgcugaccucuucaucgcaacaaaaucccuguacgacgggauccuccucgcuggcauccuauccaccaccgacagcaccaccaaagcgccucuauccucauccaugguuaacagauaugaggaacaccaaaaggaccucgcgcuacugaagaacuucauccaccaaaaccuaagcgacaguuacaaagaagucuucaaugacaaguuaaaagacggauacgcaggcuacaucgaagggaaaaccacucaagagaacuucuaccgcuucaucaaaaaggcaauagaaaagaucgaggguuccaauuacuucauagacaaaaucgaccgcgaggacuuccuuagaaagcagcgaacauuugacaacggcucaauaccccaccaaauccaucugcaggagaugcacgcaauuauucgaagacaagccgaguucuaccccuuccucguugaaaaccaagacaaaaucgaaaagauccucacguuccggauuccauacuauguaggcccacucgcucgagggaaaucggaauuugccuggcugaacaggaaaagcgaugagaaaauccggcccuggaacuuugacgaaauggucgacaaagaaacgagcgccgaaaacuucaucacccgcaugacgaacuacgaucgcuaccugccggaccagaagguacucccaaaacacagccuccuauacgaaaaauucgcgguauacaacgaacucacaaaggugaaauucauugccgaaggcaugcgcgacuaccaauuucuagacuccggacaaaagaaagacauugucaaaacccucuucaaaaccaaaagaaaggucaccgccaaagacauuaaagcauaccuugaaaauagcaacggauaugccgguguagagcuaaaaggcuuagaggaacaauucaacgccagccugcccacguaccacgaccuccucaaaauacuccgagacaaagcauucaucgaugcggaagagaaucaagaaauacucgaagacauuguccuuacccugacccuguucgaagaucgggaaaugauacggaaacgacucgagaaguacaaagacauauuaacagaggaacagaggaagaaacucgagcgacggcacuacacgggcuggggucgccugucggcgaaacucauaaacggcauacucgacaaggucacacgcaagaccauacugggauauuuaaucgacgacggcacuuccaaccggaacuucaugcaacugaucaacgacgacacacucucuuuuguugacgaaauacgccucgcacaaggcucaggcgaagcugaggacuaccgugccgaaguccaaaacuuagccggauccccagcgauuaagaaaggaauccuccagagcuuaaaaauaguagacgaacucaucgaaguaaugggcuaugagccagagcacaucguuguagagauggcacgcgagaaccaauucaccaaccaaggccggcgcaacucccaacaacguaucaaccgacucgaaaaugcccucaaagacuucggcagcaaaauccucgaggaacaaaaacccuacgggguuuccaaaguaaauaacauacaccuacaaucagacagacuguuccucuacuaccugcaaaacggcaaagacauguacaccgacgaggaacucgacauagaccaccucagcgaauacgacaucgaccauaucauaccccaagccuucaucaaagacgacucccucgauaacaaaguauuaacaaagucggcgaaaaaucgaggaaaaagcgacgacguccccagcauggaaauuguccacaaccgcaaaaacuucuggcgucaacugcucaagagcaaacucauaucacaacgcaaauucgacaaccuuacgaaggcagaacgcggaggccuaaccaacgaggacaaggcccgcuuuauccaacgccaacugguggaaaccaggcaaauaacuaaacacguggcccguaugcuugacacacgauucaauacaaaacuggacgaggcgggaaaucgaauccgcgaucccaaaguaaacaucaucacacuaaaaucaaaucuagucagccaauuccgaaaagacuaucagcucuacaaaauccgcgaaaucaacaacuaccaccacgcacacgacgccuacaucaacgccguugucgcuaccgcccuacucaagaaauacccucaacucgcacccgaauuuguauacggcgaauaccccacuuacaacucguacaacagccgcaaauccgcaaccgaaaaaguccucuucuacucuaacaucaugaacuucuucaagcgcauagucguacacucgaaaaccggcgaaguccguauacggcccguaauagaggucaacaaagagacuggcgagaucgucugggacaaaaagagcgacuuucgaacgguacgaaaaguccucagcuacccacaaguaaacguggucaaaaagacagagguccaaaaccacgggcuagaucguggaaagccaaagggcuucuacaacgccaaccuuucaccacggcccaaagaaggaucagucgagaaccucguccccgccaaacaauccuucgacaccaaacgguacggcggcuaugcaggaaucagcaacucguacgcugugcucguaaacggcaucauagaaaagggcaaaaagaaauccaaagccgagguaacagaguuccaaggaaucagcauccucgcucgaaaagacuucgacaaaaauccgaaacaauaccuacucaaccucggauauaaagacauaaaauccauaauaaaacuucccaaauacucucuauucgaacuagaaaacggcucccgccgaaugcuggcgucuauccuauccacaaacaacaagcgcggcgaaauccauaaaggcaaugaaauguaccucccagacaaauucguaacgcuccuauaccacgccaugagagucaacagaacccuggaaccgggacacaagaaauacgucgaaacacacaggcacguguucgaugaacuccuuauuuacauccuugaauacaacgagaaaauagucggcgcuaaggcgaacggaaaacguaucgucgaagccuacuccgcccgcaaagacaccgacaaccuagaggaacucugcaacuccuucaucaaccugcucaaucuaacagcccuaggcucugccgucgacuucgaguucuuaggaacaaaaauuccccgauaccgugacuacacccccuccagccuccugaaggcaacacucauccaccaaagcgugacaggccuauaugaaacacgcaucgaccucagcaaguuaggcggagacuga

SEQ ID NO: 6690 - RNA, 4146 nt, Artificial Sequence
  Cas9 variant
augaacuacguaaaggaauaccacauuggccuugacaucggaaccuccuccauaggaugggcgguaacggacagccaauucaagcuaaugcggauuaaaggcaagacugcaaucggaguccgccucuucgaggaggggaagacagcagccgaacgccgcaccuuccggaccacccggcgaagacuaaaacgacggaaauggcgcuuacauuaccuagacgagauauucgcaccgcaucugcaagaggucgacgagaacuuucucagacgacugaaacagagcaacauacacccagaagaucccgccaaaaaccaggcuuucauuggaaaacuacucuucccggaccuacuaaagaagaacgagcgaggguacccgacgcuaauaaaaaugcgagacgaacuaccaguagaacaacgggcccacuauccagucacaaacaucuacaaauuacgagaagcaaugauaaacgaggaccgacaauucgaccuccgagagguauaucucgcagugcaccacaucgucaaauacagaggccacuuucuaaacaacgcaucaguagacaaauucaagguaggccguauagacuucgacaaauccuuuaauguccuaaacgaggccuaugaggagcuacaaaacggcgaaggauccuucaccauugagccguccaagguugagaaaauaggacaacugcuacucgacaccaagaugcguaaacucgaccgccagaaagccguggccaaauuccucgaagucaaggucgccgacaaagaagaaacaaaacgcaacaagcaaauugcaacagccaucagcaaacuugugcuaggguacaaggcggauuucgccaccguagcaauggcaaacggcaacgaauggaaaauagaccucagcucagaaaccucagaggaugaaauagagaaauuccgagaggaacugagcgacgcgcaaaacgauauacugacggaaaucacgagccuauucagccaaauuaugcucaaugagauagugcccaacggaaugucgauaagcgagagcaugauggaccgauacuggacucacgaacgccaacuggccgaaguuaaggaauaccuagcaacccaacccgcauccgccaggaaagaguucgaccaaguauacaacaaauacauaggacaagcgcccaaagaaaaagguuucgacuuagaaaagggacugaagaaaauccuauccaagaaagagaacuggaaggagauagacgaacugcuaaaagccggagacuuccuacccaaacaacgcaccagcgcgaacgucgucauaccucaccaaaugcaccagcaggaacuggacagaaucaucgagaaacaggcaaaauauuauccuuggcuugccaccgaaaacccugcaacaggagagcgagaccgacaccaggcgaaguacgaacucgaccaacucgucagcuuccguauccccuacuauguaggcccgcucguaacccccgagguccaaaaagcaacaucgggggcgaaauucgcgugggccaaaagaaaagaggacggcgaaauaacacccuggaauuuaugggacaagauagaccgggcggaaucugccgaagcauucauuaaacgcaugaccgugaaagacacauacuuacugaacgaagacguccucccagcaaacucacuccuuuaccaaaaauacaauguccuaaacgaacucaacaacguccgcgucaacggacgacgacuaucaguggguaucaaacaagacaucuacagcgaauuauuuaaaaagaagaaaaccgugaaagccagcgacgucgcaagccuagugauggcaaaaacccgcgguguaaacaaacccagugucgagggucuauccgaccccaaaaaguuuaacagcaauuuagcaacauaccuagaccucaagucaauaguaggagacaaaguagacgacaacugcuaucaaaccgaccuugagaacauaaucgaguggcgcagcgucuucgaagauggggaaaucuucgccgacaaacuuacagaaguggaguggcugacagacgaacaacgcagcgcccucgucaagaagcgcuauaagggguggggaagacuuagcaagaagcuacugaccgggauagucgaugaaaacggccagcgaaucauagaccuuauguggaacaccgaccaaaacuucaugcagaucguuaaccaaccggucuucaaagagcaaauagaccaacuaaaccagaacgcgaucacuaacgacggcaugacccuccgagaaagaguggaauccguacuggacgacgccuacaccuccccgcagaacaagaaagccaucuggcagguaguacgugugguggaagacaucguaaaagccguaggcaacgcaccuaaaagcaucuccauagaguucgcgcgaaaugaagggaacaaaggagaaauuacacgaucaaggcgaacgcaacuucaaaaacuauucgaagaccaagcacacgaacugguaaaagacaccucgcuaacagaggaacuggagaaggcacuagaccucucggaccgcuauuaccuauacuucacccaaggcgguaaagacauguacaccggagacccaauaaacuucgacgaaauaucuacgaaauacgacauagaucacauccugccucagagcuuugucaaagacgacagccucgacaaccgcguccuagucagucgagccgaaaacaacaagaaaagcgaccgagugccugccaaacucuacgccgccaaaaugaaaccauacuggaaucaacuccuaaaacaagggcucaucacacaacgcaaauuugaaaaccucaccauggacguagaccaaaacaucaaguaccgcagccuuggauucguaaagaggcaacucguagagacccgacaagugaucaaacugaccgcgaacauccugggcucuauguaucaagaggccggcacagacaucaucgaaacgagagccggauugacaaagcaauuacgcgaagaguucgaccucccgaagguccgcgaagugaacgauuaccaccacgccguugacgcauaucucaccaccuucgccgggcaguaucucaaccgacgcuaucccaagcuaaggucuuucuucguauauggagaauacaugaaauucaaaagaggguccgaccugaagcucagaaauuucaacuuuuuccacgagcugauggagggagacaagucacagggcaaggugguagaccaacaaaccggcgaacuaauaaccacccgagacgaaguggcaaagaguuucgaucgacuccucaauaugaaguauaugcuggucaguaaagaaguacacgaucgaagcgaccaacuauacggggcuacaauaguaaccgcaaaagaaagcggcaaacuuacaucccccaucgagaucaagaagaaccgcccagucgaccuauacggagcuuacacuaacggcacuagcgccuuuaugaccauaaucaaguucacaggaaacaaacccaaauacaaaguaaucggagucccaacaacaucagcaguaggucuuaagcgagucggaaaaccgggaucggaguccuacaaccaagaacuacaccgaaucaucaaaaguaaccccaagguuaagaaagacuucgaaaucgucgugccacacguauccuacucgcaacucaucgucgacggcgacugcaaauucacgcucgcgagcgacacauaccagcacccugcgacucagcuaguccugagcaaagaaagcauggagauuaucgccgacgacuuuaaauucgugaaggaaaaccccgcaacagccgacgaacaacucgucaggguuuucgacgagaucgucaaccaaaugaaucacuacuucacaaucuucgaccaacgcucaaacagacaaaaaguuacgaaagccagagacaaauuugugucccuaccaacagaaucagaauaugagggagccaagaaaacgcaagucgggaaaacagaaguaaucaccaaccuacucauggggcuacacgcaaaugccgcacaaggagacuugaaaguccugggacuaucaacguuuggcuuuuuccaaucaucuggaggacucaaccugagcgaagacgcaaugauagucuaccaauccccgaccgggcucuuugaacggcggauaugccugaaagacaucuga

SEQ ID NO: 6691 - RNA, 4146 nt, Artificial Sequence
  Cas9 variant
augaaacaaauccugaagaaaguacaaggcuacaacaucggccuagacauugggacgaacagcgucggauggguagucaccgacgagaacgcuaaccugcuccaguuccgcaagaagaacauguggggcgcccgcuuguucgaaaaaggggacaccgcacaagggcgaagacucagucgaucaacucgaagacgauacgaccgacgccgacagcgaauccacuaucuccaagaaaugcuagccaccaugguacugcccaucgaugaaucauucuucauucgacucaacgaggccuuucuguggaaggaggacaaaaguguccaaagagacuacauccuauuugcggacaagcaguucacagaccgcgacuucuacaaacaguucaaaacaauauaccaucuccgcaaguucuuacuagacacaaaagaaaaggcggacccaagauucauauaccucgcacuucaccacaugaucaaguaccgggggaacuuccuauaccagggacagucauuugacguagucgaaaauguccaagaauccuuccgcgugcuccucgaagagauguacgagcaacuuggcaaggagugggaguacggggagcacuucgacgacauccagcgcauacucgaaaacacaacaaucgggaagaaaucaaaacaggagcaaaucgccgcaauccucaccgagcaguacgggaacaagaaacucgccaacgagguaacacgcgcaugccuaggauacuccuucgaccucaccgucgugauggaaaacgagaaccuccucgacgaauccggaaagaaaaucaaaaucaguuucucagacaguaaauacgaggagcaagagcuagaacugcaaaaccggcucgaagaaaaauucgcaguaaucgaagcauuaaaaaggaucuacaacuggcugguacugaaagacacacuucgaggaaagaaguauaucucagaggccaugguaaacaaguacgaagcccaccacgaagaucucgucaaacucaaacgacuuuuccgcaccuaccugagcacggaggaauauuccugcuuuuucaggaaagaaaaacaaaaagacaaauacauaucgaacuacguaaacuacaggaagggggccgaacguugcucaaaggaaaaacuauauaaagcgauccacgaguuguuugacacuguggccaaagacgacgucguauaccaggaaaucgucgagaagauggaccaaggcgaguuccucacgaagcaaaacgaaguaagcaacgccuacaucccauaucaaugcaaugaagucgaaaugaagagaauauuaaaacaacagggggaguucuaccccgaacuaaaggaaaacgcggacaagauucuacaacuacuacucuuccggauucccuacuacgucggcccccuugucgacgaaaagcagagcaaguucgcauggaugaagcgccgaacgggcauggaacaaguuaagaucuacccguggaacuucgaacaggucgucgacauagaccaaaccgcagaggcuuucauaacgcggaugacgaacuauugcaccuaccucccagaagaaaagguacugccuaaacaaagccuacuguacagcgaguacgagcuccuacaggaacucaacaaaaucaaaaucaauggaaaguucagccuggaaacccguaauaaaaucaucgagcaacucuuuaagaaacagaagaaaguaaccgaaaaacaacugaagaaguggcuagugagggagcaauacugcacgacgaaggucaccgagaagauggucaaacucgacgagaacgcguacuacaucacgggguuccagaaagagaacgaguucgccagcagccuaaccagcuacaucgacuucacgaagauacucggagaaauaaccgaacguaaccgcaaaaugauagaagaaaucauauacuggcuaacgguguucgaagaaaaguccaucgucaaacgaaagauucaaaagaaauauggcaacgaaaucaacgauaaacaacucgcacaaauccucaaacucaacuacagcggaugggggcgguucagcgagaaauuccuaaacggaauaaaaggcuucgaccggcaagggcaaaagaagacaaucauggaacugcucagggaagauagccggcugcuuaacauaaugcagauaauuaauaacgaagaaaugggguuuugcaagauaaucgaggcaaaccaaaagaagcucuacgguaacgagaaccugcucgauguaguacaggaauugcacggaagucccgcaauaaaacgcgggauauggcaaucacugaaaauuguagaagaaaucaucaguaucaugggaggggucccccaaaacaucuucaucgaguucgcccgggaagaugacgacaggguaagaaccaacucccgcgucaaacaaaucgaacggcucuacaagaaguucaaagaggaggugaacgacuucaacgaacacgcugcaaacgaacucaaggagaaaagauaucaaaacagaaucgacgaagaaaaggucuuccuauacuuuaugcaaaacgggaaaagccuguacagcggcguaacacuggacaucgaccggcugaacgaauacgaaguagaccacauaaucccgcgaacgcucgucaaagacgacucccuagaaaacaaagcgcuugugcuaaaaggcgaaaaucaacgcaagggcgaaggacugaucccacacgaguggcagaacaggcaaaaggaaguauggaagaaacuccuguccuguggccugaugggcaagaagaaauaugcaaaucugugcaaagagagcuucggaaaugaaaaagagcagaaacacuucaucgcgcgacaaauaguggaaacucgacaaaucauaaaacaaguggccaacauucucgcccaguacuaccaaggggugaacguagccgcagucaaagccucccucggauccgaacuccgggaaaacuacacaaucgaaaagaaagacgacaacggauucuucauggagaacaaaaguuacacaauguuaaaaucgcgaaaaaucaacgacuuccaccacgcccaagacgcguaccucgccugcgccgugggccuauacaucaaagcagcuuuccccaaauacgaaaaagaaaucgacuacgaaggguacagaaaauacuaccagaagaaaaaccagcaaaaagacgggguaagaaaugagaagcgacaguucuucagcuaugugaugucgcgcuucagcgaacaaauagucgauaaagagaccggcgaaauccuaugggacggcacgcaaaagcuagcguacaucaagaaaaucuucgguuaccgagacugccuaauaacgaagaaacuugaagaaaacaccggagaguucuacaaacagaccaucaaugcaaaacccgaaaaaggcaaagaaaauaacacaaaacuccuacccaucaagaaggggcuaagcguagagaaauacggaggcuaccagggaggcgaagccgccuacucgugccugguccgcuaccagcaagggcgcaaaacaaaguuaagccuugaaaagauaucaguaauaauagccaagaaaauagccgagaaagaaguaagccucgaccgcuaccugaaggaaaaacuggggguugaagaaauagugauccuacgcaagaagguaaugaaaaaccaacuuauagaggacagcgacggcaacagguucuaccucaccgccgccaccgaggucgucaacgcgaagcaguucauccuagacggaaaacaccaacaccuccuaaggacuaucgcaauaauggagaaaggugaguauuacggauaccgccucgacgaacucgaaaauaguauggacgaacuauaugcauacuaccggaugaagauccaacagcaguacccggcguacgagucgauaguaaagaaaaucguagaaagccacguguacgaaucacuucacguggaagagaaaauaaaagccgugcaggaaaaagggaaauuccucauccaacuacucagacucaccgaagcaaacgccgaaugcauagacuugaaaacgaucagcgacgggagacuggccgaccggauagggcgcaagaaccacuacaccauaaaggaaggaaucaaauucaucgaccagagcaucacgggacucuacgaacgauauaugacagucuga

SEQ ID NO: 6692 - RNA, 4146 nt, Artificial Sequence
  Cas9 variant
auggacuaugucaaggaguaccacauagggcuagacaucggcacgucuagcaucggcugggcuguaacagacagccaguuuaaacuaaugcgaaucaaagguaagacagccaucggaguccgccucuuugaggaagggaaaaccgcagcggaaagacggacauuuagaacgaccaggagacgccuaaagcgccguaaguggcgccuucacuaccucgacaagauauuugcgccacaccuacaggaaguagacgagaacuuccuucgccgccucaaacaaagcaacauucaccccgaagaccccgcgaagaaccaggcauucaucggaaagcuccucuucccugaccuacucaagaaaaacgaacgcgguuacccaacacugauaaaaaugagagacgaacucccaguggagcagagggcacacuacccggucaccaacaucuauaaacuccgagaagcaaugauaaacgaagaccggcaauucgaccugcgcgaaguuuaccuagcuguccaucauauaguaaaauaccgaggccacuuccugaacaacgcaagcgucgacaaguucaaggugggccguauagacuucgauaagucauucaacguccuaaacgaagccuacgaagaacugcaaaacggggaaggcagcuucacgauagaaccauccaaaguagagaaaaucggacagcucuuacuagauacaaagaugcgcaaacuugacagacaaaaagccgucgccaaacuccuagaagugaaaguggccgacaaagaggagaccaaacggaacaaacagauagcgacagccaugucuaaguuaguacuaggauacaaggcagacuucgccaccgucgccauggcgaacggcaacgaguggaaaauagaccucagcuccgaaacgagugaagacgaaaucgaaaaguuucgggaggaacuguccgacgcucaaaacgauauccuaaccgaaauaacgagccucuucucccaaauuaugcuaaaugcgaucgucccaaacggaaugagcauaagcgaaagcaugauggaccgauacuggacacacgagcgacagcucgccgaaguaaaagaauaucuggcaacgcaacccgcaagugcacggaaggaguucgaccaagucuacaacaaauacauaggccaaguacccaaagaaaaaggauucgaccuugaaaaggggcuaaagaaaaucuuaagcaagaaagagaacuggaaggaaaucgacgagcuccugaaagcaggggacuuucuccccaaacagaggacaagcgcgaauggagucaucccacaccaaaugcaccaacaagaacucgacagaaucaucgaaaaacaggcaaaauacuaccccuggcucgccacugagaaccccgccacuggcgagcgcgauaggcaccaagccaaauacgagcuggaccagcuagucuccuucagaauaccguacuacguaggcccacucgucacaccggaggugcaaaaagccaccuccggugcaaaauucgccugggcuaaacgaaaagaagauggcgaaaucacccccuggaaccucugggacaagaucgaccgagcggaaagcgccgaagcauucauaaaacgcaugacugucaaagacacauaccuccucaacgaggacguacuccccgcaaacagucugcuauaccaaaaauauaacguccugaacgaacuaaacaacguucggguaaauggacggcgguuaucaguaggcauaaagcaagacauuuacacggagcuguucaaaaagaagaaaacagucaaagccggagacgucgccucccuuguaauggcgaaaacacgcggcguaaauaaacccagcgucgaaggccuauccgauccaaagaaauucaacucuaacuuagcaaccuaccucgaccucaaaaguauaaugggcgacaaaguggaugacaaccgcuaccagauggaccucgagaacaucauagaauggcggagugucuucgaagacggcgagauauucgcagacaagcugacagagguagaauggcucaccgacgaacagcgauccgcgcucguaaagaaaagauauaaaggcuggggucgacucuccaagaaacuucuaacagggauugucgacgaaaauggccaacgcauaauagaucuuauguggaacaccgaucaaaacuucaugcaaaucgugaaccaacccguauucaaagagcaaauagaucagcuuaaccaaaaagcaaucaccaacgacggcaugacccuaagagagcgaguagaauccguacuugacgacgccuacaccaguccccaaaacaagaaagccaucuggcagguaguucgagugguugaagacaucgucaaagcgguuggcaacgcaccgaaaucuaucuccaucgaguucgcacgaaacgaagggaacaaaggagaaaucacacgcucgagaagaacccaacuacaaaaacuguucgaagaucaggcacaugagcuaguaaaagacaccagccucacagaggaacucgaaaaggcuccggaccugagcgaccgauacuacuucuacuucacccaaggcgguaaagacauguacaccggcgacccaaucaacuucgacgaaauauccaccaaauaugauauagaccacaucuuaccgcaaaguuucguaaaagacgauagccucgacaaucgaguccuuguaucgcgagcggaaaacaacaagaaaucagaccgcgucccagcgaaauuauacgccgcaaaaaugaaaccuuacuggaaccaacuacuaaaacaaggccucauaacacagaggaaauucgaaaaucucacaauggacguagaccagaacauaaaauacaggucacuaggguucgucaagcgccaacucguagagacgagacagguuauaaagcucaccgcaaacauacuaggaucgauguaccaagaggcaggaacggacaucauagaaacucgagcgggucuuaccaaacagcucagagaggaguucgaccuccccaaaguccgcgaagugaacgacuaccaccacgcgguagacgcguaucuaaccaccuuugcaggccaauaccuaaaccgccgauacccgaagcuccgguccuucuuugucuacggcgaauacaugaaauucaaacacggaagcgaccucaaguuacgcaacuucaacuuuuuccacgaacuaauggaaggggacaagucacaaggaaaagucgucgaccaacaaaccggcgaacucauaaccacgagggacgaagucgcuaagagcuucgacagacuccugaacaugaaauacaugcugguaucgaaagaaguccaugaccguagugaccagcucuauggagcaacaauagucacagccaaagagucgggaaagcugaccuccccaauagagauaaagaaaaaucgccccguagaccuguacggggccuacacaaacggcaccuccgcauucaugaccaucaucaaguucaccgggaacaagccaaaauacaaaguaauaggaguuccaaccaccuccgcggugggccucaagcgcgucggcaaaccaggaagcgaguccuacaaccaagaacuccaccgaauaaucaaaucuaaccccaaaguuaagaaagacuucgagauuguuguaccacauguaagcuacucacaacucauugucgacggagacugcaaauucacccuugccagcgacacuuaccagcacccagcaacgcagcuaguucucuccaaagaaagcauggaaauaaucgcugacgacuucaaauucgucaaagaaaaucccgccaccgcagaugaacaacucguccgagucuucgacgagaucguaaaccagaugaaccacuacuucacaaucuucgaccaacgaucgaacagacaaaaaguaacgaaagcgcgcgacaaguucguaucccuacccaccgaaagcgaauacgaaggggccaaaaagacacaggucggaaaaacagaaguuaucaccaaccuauugaugggccugcacgccaacgcggcacagggugaccucaagguccuuggccuauccacauucggcuucuuccaaagcucgggagggcucaaccucagcgaagacgcgaugaucguguaccaaucacccacgggguuguucgagcgacggauaugccuaaaggacaucuga

SEQ ID NO: 6693 - RNA, 4146 nt, Artificial Sequence
  Cas9 variant
augaagaaauccuacgccaucggcaucgacaucggcaccaacuccgucggccauugcgucauguauacugaaaacuacaaaguacccagcaaaaagaugaaaguauucggcaacaccgaaaaacgauacaucaagaaaaaccuguuagguacccugcuauucgaugagggcaacacagccgaaaaccggaggcuaaagcgaaccgcccgccgucgguauaccagacgacgcaacagaaucuuauaucuccaagagaucuucgccgaagaaaucaacaaaaucgacgauucuuucuuccaacgccuggaugacaguuuccucauagucgaagacaagcaaggcucaaaacacccgaucuucgggacccuacaagaagaaaaagaauaccauaaacaauuucccacgaucuaucaccuccggaaacaacuagccgacagcucacagaaggccgacauaaggcugauauaucuagcccucgcccacauuaucaaguaccgaggccacuuccucuucgaaggagaccuaaagagugaaaauaaagacguccaacaucuauucaacgacuucguggagauguucgacaaaacugucgagggcucauaccuaagcgagaaucuacccaacguagccgacguacucguggagaaagucucaaagagccgacgccucgaaaacauccugcacuacuucccgaacgagaagaaaaauggccuguucgggaacuuccuugcacucgcgcucggacuucaacccaacuucaaaacaaacuucgaacucgcagaggacgccaaaauccaauucucuaaagaaacguacgaagaagaccuggaggaacuacugggcaagauaggcgacgacuaugcggaccucuucauagcgacgaaauccuuauaugacggcauccuccuagccggaauacucucaacaaccgacucaacuacgaaagcgccuuugagcucgucuauggucaaccgcuaugaggaacaccaaaaagaccuugcccuccuuaaagacuucauucgacaaaacuuauccgacucauacaaggaguucuucaacgauacgcugaaagacggcuacgcgggcuauaucgaaggaaagaccacccaggaaaacuuuuaccgcuucauaaagaaagccaucgagaaaauugaaggaagcaacuacuucauugacaaaauugacagggaagacuuccugagaaaacaacggacauucgacaacggauccauaccccaccagauccaucuacaagaaaugcacgcaaucauucggcgccaagcagaguucuacccauuccuaguagaaaaccaggacaaaauagaaaagauacuuacuuuccguauacccuacuauguggggccccuugccagaggcaaguccgaauuugcauggcuuaaaagaaaaucagacgagaaaauucgccccuggaacuucgacgaaauggucgacaaagaaacaucagccgaaaacuucaucacccgcaugacuaacuacgaccaauaccuaccggaccagaaaguccuacccaaacacagccuacucuacgaaaaauucgcuguauacaacgaacucaccaaaguacgcuacguaacugaacaaggaaaauccuucuucuucgaugcgaacaugaaacaagaaauauucgacggggucuucaaaguuuaccgcaaagucaccaaagaaaaauuaauggacuucuugggcaaagaauuugaugaguucagaauagucgaucuuaugggccucgauaaagacaacaagucauucaacgcaucccugggaaccuaucacgacuugaagaaaauagucagcaaagaccuccuugauaacccagaaaacgaggacauccuagaaaacgucguccuaacccucacgcuauucgaagaccgcgagaugauucgcaaacgacucgagaaauacaaagacguacuuaccgaagaacaaagaaagaaacuagagcgacgccauuacacuggauggggccgacugagcgcgaaacucaucaauggcauccgcaacaaaaccacacgaaaaaccauucuagauuaucuuauugaugacggcacuucaaacagaaacuucaugcaacuaauccacgaugacacucugagcuucgucgacgaaauccgccuugcgcaaggcucaggcgaagccgaagauuaccggaccgaaguccaaaaccuagccgguagcccagcaauuaaaaaggggauccuccaaucguuaaaaaucguggaugagcuuaucggugugaugggauacaauccagaacacguuguaguagaaauggcucgggaaaaccaguucaccaaccaagggcgccgcaguagccagcaacgauauaaaaagauagaaaacgccaucaaaaaccuggacucgaaccucaacucgaaaauccugaaggaguacccgaccaacaaucaagcacuccagaaugaccgccucuuccuuuacuaccuccaaaacggcaaagacauguacaccgacgaagaacucgacauugaucaacuaagccaguacgacaucgaccacaucaucccccaggccuucaucaaagacgacucgcucgacaauaagguacucaccaaaagcgcaaagaacaggggcaaauccgacgacguacccucccuagagaucguacauaaaaagaaaaacuucuggaaacaacuccuugacucacaacugaucucccaacgcaaauucgauaaccuaacaaaagccgagaggggcggucuaacgaaugaagacaaagccagauucauccaacgccagcucgucgaaacgcggcaaauuacuaagcacguugcccgcauccuggauacccgauucaacacaaaacuugaugaugcaggaaacagaauccgcgaccccaaaguuaacauaaucacacugaaaucaagccucgucucgcaguuccgcaaagauuaccaacucuacaaaguuagagaaaucaacaacuaccaccacgcgcacgacgcuuaccuaaacgccguagucgccacagcacuccucaagaaauacccccagcucgccccagaguucgucuacggcgacuaccccaaauacaacagcuacaaaagccgcaaaagcgccaccgaacgggugcuauucuacuccaauaucaugaacuucuuuaagagagucgugaaaucuucaaagaccggcaccguaaaaauccgccccauuauugaagugaacaaagaaacuggggaaaucguuugggacaagaaaagcgacuuccggaccguccguaaaguucuuagcuacccacagguuaacgucgucaagaaaaccgaagugcagaaccacggacucgaccgcggaaaaccaaaaggcuucuacaacgcuaaucugaguccucgaccgaaggaaggcucagucgaaaaccucguucccgccaagcaauccuucgacaccaagcgcuauggcggcuaugcagggauaucaaauucauacgccguucuggucaacggcauaauagaaaaaggaaagaaaaagaguaaagccgaaguuacugaguuccaaggcauuucaauccuggcccguaaggauuucgagaaaaaccccaaacaguaccuccugaaccucggauacaaagacaucaaauccaucaucaaacugccgaaauacucacuauuugaacuugaaaacggcucacgccgaaugcucgccuccauccucuccaccaacaauaagcgaggcgagauucacaaagggaacgaaauguaucucccugacaaauuugucacgcuccucuaccaugcaaugcgcgucaaccggacucuagaaccgggacacaagaaauacguggagacccaccgccacguuuucgacgaacuacuuacuuauauccuugaauacaacgagaaaaucgucggcgccaaagccaacggcaaacgcauuguggaggcauacagcgcacggaaggacacugacaaccucgaggagcucuguaacagcuucauaaaucuacucaacuuaaccgcacucggaucagcagucgacuucgaguuccuaggcacuaaaaucccacgcuaccgggacuacacacccagcucacuccuaaaagccacucucauucaccaaucugucacaggacucuacgaaacaaggauagaccucuccaagcugggaggagacuga

SEQ ID NO: 6694 - RNA, 4146 nt, Artificial Sequence
  Cas9 variant
augaagaaaauaauaggcuuagaccugggaacaacgucgauaggcugggcauacgugcacgaagccgaauccgcacaagaacggagugagauaguaagacuaggcgccaggguuguaccacucacaaccgacgaacaagacgaauuuaaaaagggaaagagcauaaccacaaacgcagcccgacucagcaaaagaucauugaggcggaacgcagacagauuccaacuuagacgcgaugaacucgccgggguaaugaaagaggcaggauggaucgacgaaacaacgguucuagcagaacaggggcccagauccaccuucgaaacacuacgacuucgcgcaaaggcagcuagcgaggaaguaacccuggcggaguucgcccgcauacugcugcagaucaaccggaagcgaggguacaaaagcaaccgcaaaaccgacggcgacgaagaaggcgcucucauagacggaauggacgucucuaaacagcugaacgcaagcggccagacuccuggagaauggguguuagcccgaaugcaagagggcaacgcggucauccccgcauucuacuguucagaccuaagcgaggagcuagaucgaaucuggagaaaacagcaagccucucaucaagcguggaugaccgaggaacuucacaccguuuuacgccacgccgacgggagauccgcgauacgacuuauggauaaggcaggcguaguacccgacucggucaacguaaaggagcgaagacgaguaauguacgaauggcgcgccgccgcgguccgagacugccugcccgccggacgcguggccgcggccuuaaugcaagugaguaaagaaauaggcagagcagacucguaccugggcagaaucggcgaccgaucgaaggaacuuuacuuccaccggcaaacggugggccaauaccucuggcgcuugaucugugacaacccgaaccaaucgcucaaaaaccucgucuuuuaccgacaagacuaccaacacgaguucgagacccuauggagcauacagaccaaauaccacgucgaacuuaccgaggaccuaaggaaacgcguagggaggaucaucuucuuccagcgcccccugaaaaguaagaaaggucuaguuaaccgaugcgagcuaguacacuauagcgugugcgaaaacucgggagacgaccuaacggagaaaguagacgugggaccaaaagucugccccaaaucaagcccccuguuccaagaguucaagguguggcaagugcucaacaacguggaagucauacauccauccacccaagaagcgagacggcucgaaauggaagaaaaagaacuacuagcaagcgagcuccuguuccgggacagaaugaaaaagauagacguacugaagcuacucuucaguaacuggcgagaccuggaucugaacuauaaggagcuggaagggaaccgaacaauggcagccuucuaccgcguauacgagcaaguuauagcacaaacaggacauggagacuacgauuuugccaagaugcgcgccgcaaaagucaaggagcuggccgagggaguauucgccggccuaggcuuugaaguaggacugcucacguucgacgcagaacuagauucaccagccuacgaacaacagccaugcuauaggcuuuggcaucugcuguauaguuacgaaggcgacaaaucagcaacgggaaacaaaugucugcugaagaaacugugcagacuaacaggaaugaaugcagagcuagucggccuauuuaugcaaauacgauucuccggggacuacggcagccuaagcaccaaagccaugcggagaauacuccccuaccucaaagccggaaacaccuacgacgucgcgugugaauacgccggcuuucgccacagcgcgaggucccuuacgcgcgaagaauuagcgcaaaaagaauacaaggacuaccucgauuuauuaccccgaaacucacuuagaaacccggucgucgagaaaauacuaaaccagaugauucacguaguaaacggacugucauccacauacggcaagccagacgaaauccgcguagaaauggcgcgcgagcuaaagaaaagcgcacgcgagcgagaggagaugaccuccgcgauaagcaaaaccacgaaggaaaaugcagaaaucacggcaauccuacaacgggacuucggccugcgauacgucucgagaaacgacaucuugagauacaaacucuacugcgaacugagaauaaagggcaacggaugccgcacacuguacucgaacacauacaucaacccaaacgaauuauucagcagggaguucgacaucgaacacauaauaccccaaucgcgucuauucgacgacagcuucuccaacaaaacacuggaaucaagaacagcaaaccucgaaaagggagaccgaacagcaugggacuacguuaacgaaaaauacggcgccgaaagggccgacgaauacagagcacaagucgaagccuuauaccgagacggaacgauaagcaaagcuaaacgggacaagcuccuaaugcccggcgacaaaaucccagaagacuucauagacagagauaucagaaacacgcaguacaucgcaaagaaagcacucgaaauauucgaagacuucguacccucaguagucgccacgucaggaaacguaacagcccgauuaagagaggacuggggacuugucgauguaaugaaagaacuaaacuggucaaaauacgaaagucaagggauggugcacaucgaauacgaccgagauggacggcccauccgacgcaucguagauuggacaaaaagaaaugaccaccgccaccacgccauggacgcacucgcgguggcauucacaaagcgaagcuacauacaauaccugaaucaccugaacgccagaaaggaagcuacgagcgucgcauacgccauccaacacaaagaaauggaacuagauggaucaaaucgguggcgcuucaaaugcccguuuggcgaccgaagcgcauucagacgcgaagcaaaagcgcaacuagaaagaauccuggucagcaucaagucgaagaacaaagugcucacgcccagcgucaaccgaacaaagaaaagagggggcuucaacaagaaaguagaauggacgccgaggggugcccuccacaacgaaaccgucuauggccggauccgaagguacgaugugaaagaacuaaggguaggaucguccuucacagcggaggucaucggaaaagucgcggauagcagguaccgggcagcguuaaugcaccgacuagccgaguucgguggagacccaaagaaagcauucaccggcaaaaacagccucgagaaaaacccgcuguacaccgacgaagcccacacagccugcguaccaagcucgguuaaaguaguaaguuucguggaaaucggaacaauaaggaaaggaguagauccaaaccuaaacgucgacaaagucguggacacgcacauuaaaaacauacugcuugccagacuaucagcauacggcggagacgccaaaaaggcauucuccaauuuagacgcggauccgauauggcucaacaaagaaaaaggcaucgcaauaaagagaguuaccauaagcgacgacucggaagugcgaccgauacacguaaagagagacaugcguggcaggcuaguaugcgacgaacacgguagaccaguacccucagacuacguccaacuaagaaacaaccaccacgucgcaauauucagggacgccaacggcgaacucaaagaacgaguagugacuuucuucgaagcaguagaacgcguccgacaacugagaagugaggggcgcgccguugaggucauagacaaaaacuacaaaugcgaagagggguggaccuuccucuucaguaugaaaauaaacgaguacuucguauucccagaugcagcaaguggcuucgacccccgggaaaucgauuuaaccgacccagccaacuaugcccucauaucaccccaccucuuccgcguacaaaaacucucaucuaaagacuacuacuuucgccaccaccuagagaccacaguaaacgacgucaaacaguuacgcgacaucacguggaaaagaauaucaagccugcaggaucucgccgguaccguaaaaguaaggguaaaucauaucggacaaaucgucgcagucggugaguacuga

SEQ ID NO: 6695 - RNA, 4146 nt, Artificial Sequence
  Cas9 variant
augguaaagaaaaaguacgcgaucgggauagacaucgggaccaacagcgugggaugguccaucguuaccgaugacuacaagguccccaguaaaaagaugaaagucuucgggaacaccgagaaacgcuauauaaagaaaaaucuccucggaacccugcuguucgacgaaggcaacacagccgaaaaccggcgccucaaaagaacagcccgacggcgauacacacggcggagaaaccgaauccuauaccuucaggagauauucgccgaagagauaaacaagauagacgacucauucuuccagagauuagacgauagcuuucucaucguggaggauaaacaaggaagcaagcacccgauuuucggcacgcuucaagaggaaaaagaauaucacaagcaauucccaaccauauaccaccugaggaaacaauuggccgacuccucccaaaaagcagacauucgccuaaucuaccuggcucuugcacacaucauuaaguaccgaggucacuuccuauucgaaggagaccucaaguccgaaaauaaggacgugcaacaccucuucaacgacuucguggagauguucgauaaaacgguggaagguucauaccucuccgaaaaccugccgaauguggcugacgugcuaguagaaaaaguaucgaaaucccgacgccuagaaaauauccuccacuauuucccgaacgaaaagaagaacggucuuuucggcaacuuccucgcucuggcccuagggcuucagcccaacuucaagacaaacuucgaacucgccgaggacgcaaaaauccaauucagcaaagagaccuacgaagaggaccuggaagaacuccuaggcaagauuggcgacgacuacgcagaccuauucaucgcuaccaaaucgcuuuacgacggcauacuccuugccggcaucuuauccacaacggacuccaccaccaaggcaccccugagcuccagcauggucaaccgcuacgaggaacaccaaaaagaccuugcacuucucaaaaacuuuauacaccaaaaucuaagcgacagcuauaaagaaguauucaacgacaaacucaaagauggcuacgcuggguacaucgaaggcaaaacaacgcaagaaaacuucuacagguucaucaaaaaggcuauagaaaagaucgaagggucaaacuacuucaucgacaaaaucgaccgagaagacuuucuucggaaacaaagaaccuucgacaacgguucgauaccccaccaaauacaccuacaagaaaugcacgccaucauacgccgccaggccgaguuuuaccccuuccuagucgaaaaucaagauaaaauagagaaaauacucacauuccgcauucccuauuacgucggcccacuagcuagaggcaaaagcgaguucgccuggcuaaaccgaaaaucugacgagaaaauacgacccuggaacuucgacgaaauggucgacaaagaaaccucagccgaaaacuucaucacacgcaugaccaauuacgaccaguaucucccugaccaaaagguccugccaaaacacagccugcucuacgaaaaguucgcugucuacaacgaacucacgaaaguacgauacgucaccgaacaaggaaaguccuucuucuucgacgccaacaugaaacaagaaaucuucgaccgaacauuuaagguguaccggaaggucacuaaggaaaaacuaauggacuuccucuccaaggaauuugaugaguuccggaucguggaccuccuggggcuagacaaggacaacaaaaguuuuaacgcaucccuaggaacguaccaugaccuaaagaaaaucgugagcgaagacuuucuugacaacagcgaaaaugaagacauccucgaaaacgucguccuaacccuaacccucuuugaagaccgugagaugauucgaaaacgcuuagagaaauacaaagacguacucaccgaggaacaacgaaagaaacucgaacgucgacacuacaccggauggggacgacucuccgccaagcucauuaacggcauacgggacaaagugacgagaaagacgauacuugacuaccucauagaugacggcaccuccaaccgcaacuucaugcaacucaucaacgacgacacccugagcuucgucgaugagauccggcuggcccagggcagcggcaaagcagaggacuaccgggccgaaguccaaaaccuggccggcucuccagccauaaagaaagggauacuacagagccucaaaaucguagacgagcugaucgaaguaaugggcuacgauccagaacacauuguuguagagauggcccgugagaaccaauucacaaaccaaggccgccguaacucacaacaacgcuacaagaaaaucgagaacgcaaucaaaaaccucgacagcaaccuaaacucaaaaauacuaaaagaauaccccacgaauaaucaggcgcuacaaaacgaccgccuauuccuauacuauuugcagaacggcaaagacauguauacagacgaagaacuugauauagaccaacuaucucaauacgacauagaccacauaauaccgcaagcauuuaucaaagaugacucgcucgacaacaagguacuuaccaaaagcgccaaaaaccgcgggaaaucggacgacguucccuccuuggagauagucuacaagaagaaaaacuucuggcaacaacuacuagauucgcagcuaaucagccaaagaaaauucgacaaccucacgaaagccgaacguggcggauuaaccaacgaagauaaagcucgcuucauacagcggcaacucguggagacccgacaaaucaccaaacacgucgccagaauccuggacacccgauucaacaccaaacuggacgaggccgggaacagaauccgagacccuaaagugaacauaaucauacuaaagucaaaccucgucucacaguuccggaaagacuaccaacuauacaaagucagagaaaucaacaauuaucaccacgcgcacgacgcguaccuaaacgcgguuguggccacugcacuacucaagaaauacccacaacucgcccccgaguucguauacggagaguacccaaccuacaacucauacaacagccgcaagagcgcaaccgaaaaaguccucuucuauuccaacaucaugaacuucuucaagagaauugucgugcacaguaagaccggcgaagucaggauccguccgguaaucgaggugaacaaggaaaccggcgagaucguaugggacaaaaagagcaacuucagaaccguccguaagguccuaucuuacccgcaagucaacguaguaaagaagaccgaaguucaaaaccacggccucgacaggggcaaacccaagggcuucuacaacgcgaaccuauccccacgcccuaaggaagggucaguagagaaccuagugcccgcaaaacagagcuucgacacaaagcgauacggcggcuacgccggcauuuccaacagcuacgccguacugguaaacggcaucauagaaaaaggcaaaaagaaaagcaaggccgaagucacagaguuccaaggaaucagcauccucgcacgcaaagacuucgacaaaaaccccaagcaauaccuacuaaaccucggauacaaagauaucaaauccaucauaaagcugcccaaauacucccuuuucgaacuggaaaacggcucgcgccggaugcucgccagcauccuuagcaccaacaacaagcguggagagauacacaaaggcaacgaaauguaccuaccagacaaauucgucacccuacuuuaucacgccaugcgcguaaaucgcacccucgagcccggacacaagaaauacgucgaggcucaccgccacguguucgacgaacucuugacuuacauacuagaguacaaugagaaaaucgucggagcaaaagccaacggcaaacgcauaguugaagccuauagcgcucgaaaagacaccgacaaccucgaagaacuuugcaacuccuucauaaaccugcucaaccucaccgcucuggggucagcagucgacuucgaguuccuuggcacgaagaucccccgcuacagagacuacacucccucgucucugcuaaaagccacgcucauccaccagucagucaccggccucuacgaaacgaggaucgaccuauccaaauuaggaggggacuga

SEQ ID NO: 6696 - RNA, 4146 nt, Artificial Sequence
  Cas9 variant
augguuaaaaagaaauacgcaauaggcaucgacauaggaacuaacucaguaggauggagugucgugacagacgacuacaaagucccauccaagaaaaugaaaguauucggcaacacagagaaacgcuacaucaagaaaaaccugcucgggacacuccuauuugacgagggaaacacagcggaaaaccgacgccucaaacguaccgcacgacgccgcuacacaaggagacgaaaccgaauccuauaccuccaagaaauauucgcagaagaaauaaauaaaaucgacgacagcuucuuccaaagacuugacgacagcuuccucauagucgaggacaaacaaggcucgaaacaccccaucuucggaacccuccaagaggaaaaagaguaucacaaacaguuucccacaauauaccaccuacgcaaacaacuagccgauuccucgcagaaagcggacauccggcugauauaccucgcccucgcucacauaaucaaauacagagggcacuuccucuucgaaggcgacuuaaagagcgacaacaaagacguccagcaccucuucaacgaguucgucgaaauguucgacaaaacagucgagggaucauaccuaagcgaaaauauacccgacgucgcggacauccuuguggagaagguaucaaaaucccgacgacuggaaaacgugcuacaauacuuccccaacgaaaagaaaaacgggcuacucgggaauuuccucucgcucgcccucggccuccaaccaaacuucaaaaccaacuuugagcucgcggaggaugccaaaauacaauucuccaaagagacauacgaagaggauuuggaggaacuccuuggcaaaaucggagaugacuaugcggaccuuuucaucgcaacaaagucacuauacgaugguauacuacucgcaggcauucucuccacaaccgacuccacaaccaaagcaccccuuucgucuaguauggugaacagguacgaggaacaccaaaaagaccuggcccuacucaaagauuucauacgacaaaaccucagcgauuccuacaaagaaguguucaacgacgcacuaaaagacgguuacgcaggauacauagaagggaaaaccacacaagaagacuucuacaaauucguaaagaaaaccaucgagaaaauagaagggagcgacuauuucaucgacaaaaucgaucgggaagacuuuuuacgcaaacaacggaccuucgacaacggcucaauaccacaccagauccaucuaaaggagaugcaggcuaucauaauacgacaggcgaaauucuaucccuuucuggaagaaaaccaagacaaaauagagaagauacucaccuuucguauccccuacuacguaggcccacucgcccgcggcaacucagaguucgccuggcuaaaccgaaaaagugacgagaaaauacgcccuuggaacuucgacgaaaucgucgacaaggaaacgagcgcggaaaacuucaucaccaggaugaccaacuacgaccaauaccuccccgaccaaaaaguccuacccaaacauucccuucuauacgaaaaauucgcaguuuauaacgaacuaacuaaggugcgcuacgucaccgaacaaggaaagaguuucuucuucgaugccaacaugaagcaagaaauauucgacggcgucuuuaaaguuuaccgaaaaguuacaaaagaaaagcuaauggacuuccuugguaaggaguucgacgaguuccgcaucguagaucugcugggacucgacaaggacaacaagaguuucaacgcaucgcuuggaaccuaccacgaccucaaaaagaucgucuccaaagaccuacuggauaacccggaaaacgaagacauccuggaaaacgugguucuaacccuaacacucuucgaagacagagagaugauacgcaaacgacuugagaaauacaaagaaguccucaccgaagaacagcgcaagaaacuagaacgccgccacuacaccggcuggggccgccuuucagccaaacucaucaacggcauccgcgacaagguaacgcguaagacaauccucgacuaccuaaucgacgacgggaccagcaaccggaacuucaugcagcucaucaaugacgacacauuguccuucgucgacgaaauccgacuugcacaggggucuggugaagcugaggacuacagggccgaaguccaaaaccucgccgggagccccgcuaucaaaaagggcauacuucagucccuaaagaucguagacgaacugaucgaagucaugggauacgaacccgaacacaucguuguugaaauggcacgugagaaccaauuuaccaaccaagggcgcagaaacagccaacaacgauacaagaaaauagagaacgccauuaaaaaccucgacucaaaccuaaacucaaaaauccuuaaagaauacccaaccaauaaccaggcccuccaaaacgacagacucuucuuguacuacuugcaaaacgggaaagacauguauacugacgaagaacucgacaucgaccaacuuagccaauacgauaucgaccacauaaucccgcaagccuucaucaaagacgacucucuggacaacaaagugcuaaccaaaucagccaaaaaccgggguaaauccgaugacguuccuucccucgaaaucguauauaaaaagaaauccuucuggaaacaacuucuagacagccaacucaucagccaacgaaaauucgacaaucuaacgaaagccgagcgcggaggacucacuaaugaagacaaagcacgauucauccaacgccagcuaguagagacacgacaaauaaccaaacacgucgcuaggaugcuugauacccgcuucaacacaaaauuggacgaagcaggcaauaggauaagggacccaaaagucaacaucauaacgcuuaagucaaaccucgucagccaauuucgaaaagacuaccagcucuacaaaguacgcgaaaucaauaacuaccaccaugcccacgaugccuaccuuaacgccgucguggccaccgcacuccuaaagaaauacccacagcucgcccccgaguucguauauggagaauaucccacauacaauaguuacaacagccguaaauccgccacggaaaagguacucuucuacagcaacauaaugaacuucuucaaacggaucgugguccacaguaagacaggagaagucagaauccgcccagucaucgaagugaacaaagaaacaggagaaaucguuugggauaaaaagucagacuuucgaaccguccgcaagguacuaagcuacccacaagucaacguggucaagaagaccgaaguucaaaaucacggguuagacaggggcaaacacaaagguuuuuacaacgcgaaccuaagcccccgacccaaagagggcuccgucgaaaaucuugugcccgcaaagcagagcuucgacaccaagagauauggcggauaugcggguauaagcaacagcuacgcagugcucguuaacgggaucauagaaaaggggaaaaagaaaucaaaagccgaaguaaccgaguuccaaggcauuucaauccuagcccgaaaagacuuugacaaaaacccuaaacaauaccuucucaaccucggguacaaagacaucaaaucaauaaucaaacucccgaaauacucccucuucgaacucgagaacggaucacgacgcaugcuagccucaauacuauccacaaauaacaagcguggcgaaauccacaaaggcaacgaaauguaccuaccagacaaguucguaacccuauuguaccacgccaugagggucaaccggacccucgagcccggacacaagaaauacgucgagacccacagacacgucuucgacgagcuccucaucuacauacuagaguacaacgagaaaaucguaggagccaaagccaacgggaaaagaaucguggaagccuacucagcgcggaaagacacagacaaccucgaggaacuguguaacucauucauaaaccugcucaaccugacggcccuaggcagcgccgucgacuucgaguuccuaggcacaaaaauaccacgauacagagacuacacgcccucuucccugcuaaaagcaacgcucauccaccaaucggugacgggacuguaugagacacggauagaccucucuaaacuuggcggcgacuga

SEQ ID NO: 6697 - RNA, 4146 nt, Artificial Sequence
  Cas9 variant
auggucaagaagaaauacgcaauuggcaucgacaucggaacaaacuccguaggguggucagucguaacggaugauuacaaaguaccuagcaagaaaaugaaaguauuuggcaauacugagaaaagguacaucaagaaaaaccuccucggaacacuacuauucgacgaagggaacaccgcggaaaaccgccggcucaaacgcacagcccgacgccgguacacgcggcgccgaaaccgcauauuauaccugcaggaaaucuucgcagaggagauuaacaaaauagacgacagcuucuuccaacggcuggacgacagcuuccuaauaguagaagacaaacaaggcucuaaacacccgauuuucggaacucuacaagaagagaaagaauaccacaaacaguuccccacuauauaccaucugcgaaaacagcucgcagacagcagccaaaaagccgauauacgacugauauaucuagcccuugcacacaucaucaaauaccggggacacuuucucuucgaaggugaccucaagagcgagaacaaggacgugcaacaccucuuuaacgauuucguagaaauguucgacaaaaccgucgagggguccuaccucuccgaaaaccuccccaacguagcugacguguuagucgaaaaaguaucaaaaucgcgccaccucgaaaauauccuucauuacuuccccaacgagaaaaagaacggccucuucggaaacuuccucgcgcucgcacucggccuccagccgaacuucaaaacaaacuucgaacuggccgaagacgccaagauccaauucucaaaagaaacuuacgaggaggaccuagaagaacuacuagguaaaauuggcgacgauuacgcggaucuauucaucgcuacaaagucucucuaugacggcauccuccuagcaggcauacucucuacaacgaacagcaccacuaaagcaccccuguccucaagcauggugaaccgguacgaggagcaccaaaaggaccucgcccuccugaaaaacuucauacaccagaaccuaagcgacuccuacaaagaagucuucaacgacaaguugaaagauggauacgccggcuacaucgaaggcaagacaacccaagaaaacuucuaccgcuucaucaagaaagcaaucgagaaaaucgacgggucgaacuacuucauagagaaaauugaacgggaagauuuccuccgcaagcaacgaaccuucgauaacggcagcauaccucaccaaauacaucugcaggaaaugcaagcgauaaucagacgccaagccaaguuuuacccauuccucgaagaaaaccaagacaagaucgaaaagauccucaccuucagaaucccauacuacgucggccccuuagcccgaggcaaaucugaguucgcguggcuuaacagaaaauccgacgaaaagaucagaccguggaacuucgacgaaaugguagacaaagaaacguccgccaagaacuucaucacccgcaugaccaauuaugaccaauaccucccggaccagaaaguucucccuaaacacucgcugcuuuacgaaaaguucgccgucuacaacgaacucaccaaagugagguacgucaccgaacaagggaaguccuucuucuucgaugcaaacaugaaacaagaaaucuucgacgggguuuucaaaguguacagaaagguuacuaaagaaaagcucauggacuuccuugggaaagaguucgacgaauuucgcaucgucgaccuccuuggauuggacaaagaaaacaagagcuucaacgccucccuaggaaccuaccacgaucucaagaaaauagucucaaaagacuuccuugacaacucagaaaacgaggacauccuagaaaacgucguacucacacucacucuauuugaagacagagagaugauacgcaaacgccucgaaaaauacaaagacauccucacugaagaacagcgcaagaagcucgaacggcgccacuacacgggguggggccgccuaucagcuaagcugauaaacggcauucgugacaaggugacacgcaaaacaauccuugacuaucugaucgacgauggcacaucgaacuguaacuucaugcagcucauaaacgacgacacacuaucguucguggacgaaaucagacuagcacagggaucaggagaagccgaagacuaccgagcagaaguccaaaaccuugccggaagccccgccaucaaaaaggggauacugcaaucccugaaaauagucgacgagcucaucgaagucaugggcuacgauccagaacacaucgucguggagauggcccgggaaaaccaauucaccaaccaaggacgcagaaacucacaacaacgcuacaagaaaauagaaaacgccaucaaaaaccuugacucgaaccuaaacucuaaaauccugaaagaauaucccacaaacaaccaagcccuacaaaacgaccgacucuuucucuacuaccuccaaaacgggaaagacauguacacagacgaggaacucgacaucgaucagcuuucccaauacgacauagaccacauaauaccacaagccuucauaaaggacgacagccucgacaacaaaguacucacaaaaucugcgaaaaacagggggaaaucugacgaugugccaucccuggaaauagucuacaagaagaaguccuucuggaaacaacuacuugauagucaauuaauaucccaacgcaaguucgacaaccucaccaaagccgaacgcggcggccuaacgaacgaggacaaagcccgcuucauccaacgacaacucguagaaacccgccaaauaaccaagcacgucgcccgcaugcuggauacccgcuucaacaccaagcuagacgaagccggcaaccggauacgcgacccaaaagugaacauaauaacccugaaguccaaccucguaucccaguuccgcaaagacuaccagcucuacaagguccgcgaaauaaacaacuaccaccacgcccacgacgcauaccuaaacgcagucguagcuacggcccugcuaaagaaauacccacaacucgcgcccgaguucguguacggagaauaccccaccuauaacuccuacaacucccggaaaagcgcgaccgagaaaguacucuucuacuccaacauaaugaauuucuucaaaaggauagucguucacuccaaaacaggcgaagugagaauccgcccgguaaucgaggucaacaaagaaaccggcgagauaguaugggacaagaaauccgacuuccgcacuguccggaaaguccuuuccuacccucaaguaaacguaguuaagaaaaccgaggugcaaaaucacggacucgaccgaggcaaaccaaaagguuucuacaacgcaaaccucucccccagaccgaaagaagguagcguagaaaaccucguucccgcaaaacaguccuuugacaccaaacgcuaugggggauacgcaggcauaucaaacucuuacgccguacuuguuaacggaauaaucgagaaaggcaaaaagaaauccaaagcggaagucaccgaguuccaaggcaucucaauccuagcccguaaagacuuugacaaaaauccgaaacaguaccugcucaauuuagguuacaaagacauaaaauccaucauaaagcucccgaaauauucgcuauuugaacucgagaacggcucgcggcguaugcuggcauccauucuauccacuaacaacaagaggggcgaaauccacaaaggcaacgagauguaccuaccagauaaauuuguaacucugcucuaccacgccaugcgcguuaaccggacacucgaaccgggccauaagaaauacgucgaaacucacaggcacgucuucgacgagcuccucauauacauccuagaauacaaugagaaaaucguaggggcaaaagcaaacggcaaacgcaucgucgaagcauacagugcacggaaggacacggacaaucuggaagaacucugcaacaguuucauaaaccuauugaacuuaacggcacuagguucggcgguugacuucgaauuucuaggcaccaaaauuccccgauacagggacuacacccccuccucccuuuuaaaagccacacuuauccaccagaguguaaccgggcucuacgaaacacguauagaccuuuccaaacuuggaggggauuga

SEQ ID NO: 6698 - RNA, 4149 nt, Artificial Sequence
  Cas9 variant
augaagaaaauaguaaacuacaaucucggccucgauauuggcacuagcucaauaggcuacgcagccauugacgaccaagggcgcccaguccgucaccagaacaaaacugucaugggcguacgccucuucaaagaagggaaaacggccgaaucaacgcguaucuuccgaggcacgagacgccgccuuagccaccggcacuggcgacuaggcuaccuggaccgcaucuucgauaaugaaauagccaaaguagacgaaaacuuccucccccggcugaaggcguccaaacgagcgcgcuccgacgaaaaacgcucguucagaggcagccuccucuucccagaaaccggagacgacgcuuauuaccaaaaauaccccaccaucuaccaccuccgauacgcccuuaucacgcagaagaagcaguucgauauacgucucauauaccuggcccuccaucacaugaucaaguaccgcggcaacuuccucgacacaacacccgucucugccuucaacauucacgacaucgaccuuacagaccaguuugccucgcucaaugauugcuaccagcuacucgacauggauuucgaauuucaauucgaccucaacaacaucgagcaaguccagaaacugcuacucgacgagacgcuaagcaaaacaaaaaggcaagccgccgucagcaaaguacucguuaugucaacaggcaacaaagccuuugacgaccaacaaaacgggaucgcaagcgaguucauaaaggcccuccuugggggccccuucgaccuuaguaagauccucaaccucagcgucgcggacgucaagucguggaaacuucacaugacugacaaagacgucgaugacacacucaacuccuuagucgaagaacuggaugaaaaccacaaacaaauuguaaaccuacuacagaugauauacucacaagugaugaugcugggccuauuaaacggccaacaaucgaucucagccucaaugauagaacgcuacgacgaccacgcaaagcacugggccgcucucaagaaacuacugcccgcccucggcgaacaagaacaaagcaccauaauacacgcuuacacagccuacaccgggcacucccgcacgaaacaacucucccgagcagaguucuacacaaaagucaacuccauccuaaagaaacacgaaaacaucgcugaagcaacagggcuuauagaacucaucgacaggaacgaguucaugcccaaacagcgcgacgccgucaacggcgucaucccucaucaguuacaccaacgugaacuacaacugauaauccaaaaccagcaaaaauacuacccuuuccucgccgccaaagccuaccccgacgccgaugaaaccaugaucgaacaacuguugagcuuccgaguacccuacuacgcggggccgcuaguugaccgcgacuucauaaacgaaucgagugaccaggaacaagcaaugcaaaacaccaaauucucguggcucaaaaggcgggaagcgggggaaauaacccccuggaacuucgaacaaaaagucgacguucaggaaaccgcgaaccgauuuauaaaacgacucaccaccaaagacaccuaucuaaugaccgaagacguccuacccaaagagucacuaauauaccagcgcuucgaaguccuaaacgaauuaaacgcaauaaggauaaacgaccgacgccuaacugcggaaaacaaacaacuagccuuccaacaacuguuuauggcgggaaacacgaaaaacgucucaauaaagaaauucagaaacuuugucuucgacucccugaaauucccagaaaaggucaaaauaacaggauucgcaggacagcacaacuuccuggcaaagcucucgacguaccacgacuucaagaagauauuuggcgaacgggucgaucacacugaccuccaaccugacuucgaaagaaucguggaauggugcaccauauuugaagauaggcauauuuaccgagagaagcucaaggaaauccaauggcucucccaguccgagaucgaccaauuaguacucauaaggaaccacggcuggggcagguuaagcaagcgacuucucacagggauacgcgacucagacgguagaaccgucauggaucaacucugguucgggaccgacaacuucaugcgcaucaucagucaguccgacuucgcggccgccaucgccaacgagaaccgaacccagcucaaccagcacggccucgaagacguucuugacagcgcauucauguccccacagaauaagaaagccauccgacagguauuaaaagucgucgacgacaucgaacaaacucuaggcugucccccaaagaaagucaugauagaguucacccgaaguccggacaaaaagaaacagcgaaccguaacacgucuagaaaaaguccagcaggcuuacaaagccgucgcugaucaacuggccggucaauccauaguuucggaacuugaccaauacgcaaacacucauagcaaacucuccgacacauacuaccucuacuuuaugcaacucggcagagaccucuauucagguaaaccaauagacauagacagcccaaugcuugacgacgaccacauacucccccgagcauucaugaaagauaacucacucgacaacagagcucucacagaaaaacccauuaacaauacaaaagcggccaaguuccccagcaaggucuucggacaacaaaaggaggucacagacuucuggaaacugcuccgccgcugcgggcuuaugucaaacauuaaagaaaaacaccucuaccuggaccccgacaacgucgauaaauggacccgcaggggguucauccaucgacagcuaguagaaacuucacaggucauuaagaucgucgcgaauauucuaaacgaccgauaccaacagucccaaacugagguacuagaaguucccgcacgguuaggaacugaacuacgcgaaugcuuuggcugguacaaaguccgcgaagucaacgacuaccaccacgucuucgacgcauaccucgcagccuuuaucggaaacuacuuauacaggcgcuaccccaagcuccagccguauuucguauacggcaacuuugccgaacugaacaaagcccaauuaaagaacauuaaaucuuuuaacuuccucuacaacauaacugacaacaaacgcgucgucaaggacauugaaacaggccagacccucugggacgaccaaauccgccaacaaauccaacacauauacgaauacaaguacaugcucaccucccacgaagccuucacccaacauaaagaacuguaugggcaaacgauuuacccgagaagagaguucaagcccggcacacuaaaggcaauaaagcaagaccaaccucaggaacuauacggcggauacaaaaaccucaccgcagccuauaugugcaucguaaaaauccaggcacgcaagcgccgagccgccgaauauagagucguccgcgucgccaccgaaucucuauccgcauugcagcaagccaaacgucuaggcguacaggcuuacgaaagaugccuaaggcaagaacugguacgaaauaacgaaauccugcgcaccaacgccgaccccaacuccgcuccgcgagaguucgaagugcuucucgaccgcguguuaugccaccaaaugauuaucucggacggacagaaguaccuccucggcucccacgccuacaaaaucaacugcaugcaacucguauugagcaacaacagcaugaaaauccucucaacaucgauuguuaaauugaagcagaugacgaacgaaccccuuguacaaguuuaccgagaaauccuagacgucgucaacaaguacuucacacucuacgauguaaacaguuuccgggaaaacuugaaccaauucuuugacaaguuccgaacccucccgaucacgaaugaauacgaaucaucgaaaagcggaaagaaauuaauccaccgcgggcaacucgaaacucuaacguuaauccuucgaggccuccacgccaacuccgacaaaguucaguacggagaccaaucuacgcucuuagguggauuccagacgaaagacggaaucaaacuaucaaaagacucaguaauacaguauacaucacccgcaggacucaacguacguaccguaaagcuacgagaccuagaacagaaagaagcucagaaauga

SEQ ID NO: 6699 - RNA, 4149 nt, Artificial Sequence
  Cas9 variant
auggucgacgaaaagauauucuggggauuggauaucggcacggauucagucgggugggccguaaccaacagcgaauacaaacucaaaaaguacaagaacaaccugaugugggguguccaccuauuugacgaagccaaacaaucugccgaacggcggagcuuccgaaccgcacgccggcgucuagaucgucggaagcagaggaucauccuacuacaagaauuuuucgucagagccgucugcgaaaaggaugaaaauuucuuccgccggcucaaggaaagcgcccuucuacccgaagacgccgagcaccggacaaacaacaucuucuucgacgacccggacuacaccgauaaagacuacuucgaagaguacccaacuauacaucaccuaauaugcgagcuaauggagaguaaggaaccucacgacguacgacucgucuaccuagcgugugucuacuugcuagcccacagaggucacuuccugcuacccgucagcgaggacgacaucuccaagguaaccgaguucgagccccuauacgagagcuucuacaaagcgcuagaagaaaaacuagacgaugagcccccauucgauagaucagcagaugauuuugcagagauccugaagucacacaaaaccgugagcgccaaaaacaaggacuucgauaagcuacuauucggcgguaaagucaagacguaugacaacgaaaacaucuccuacucagcccuaauaaaacuccucucuggcgggacggaaaaacucagcaaauucuucgccaaugaggaauacaccgaccucgagaaagauucaguaugcgugcggaacgcggacuuuggggacacccuagagaugcuagaggggcagauagacgaauuagacuucgcauugcucaagagcgucaagagccuauacgacuggucccuacucgucgacauccucgagggcaaaucccuuaucucugaagcuaagaaggacaaguacgacgaacacggcuacgaccuagacgccuuaaaguaucuguuccgcgaauaccucaccaaggacgacuacaacgagauguucaaagaggucucugguaagcaaaauuacgcauccuacgucuacaaugcgagcagcgacaaaacucgcgacuccaaauacaagaaaugcagccaaaaggacuucugcaaauuuaccaaaaaguuucuauccaaaaucaaacccaacgaaaaggacaagccaugccuagacaaacuucucgagaaaugcgagcagaacucacucugccccaaacaggucacaaccgacaaccgcguaauacccuaccaacuauacuacguagaacucaaaaagauucuggaaaacgcgugcggcuaucugccguuucuuaacgaacgcgacgaauacggcaccgucgcugacaaaauacuaaguaucaugaaauuccgcguaccauacuacguaggcccccucgucgacagcaagaaaucaccaaacgcauggcucguccgcaaacucgauggaaagaucacucccuggaacuucacugacaugguaaaugaggacgaaucagaaaacgcauucauacgccggaugacaugcaaaugcacguauguagcugggcaggacguccucccgaaguacucacuacuauacuccaaauucagcguucuaaacgaaaucaauaacaucaaacucaacggcgaacccaucagcguccaaaccaaacaagagauauacaccgaacucuucgaacgaaacaaaucgagggucucaaagaagaaaauccgcgacugucugaucucccacggcuacgccgcagauagcgacgaggugacgggcauagacgacaucgccaaauccgcccuccgaucuuaccacgacuucaagaaaaugcucagcaauggaauacuaaccgaacaacaaguagaggaaaucauagagcacaucacagucaccaccgacaacauaagacucaagaaauggcugaaaacacaauucccuaugcuagccgacgaagacguaaaauauauuaccaaacucaaauacaaagacuauggucgacugucccguugcuuccucgaggacguacuaccaguggacaccaaaaccggggaggccgaaagcgacaaaaacauaauaaccaugcuaugggagaccaaugagaacauaaugcagcuacugucgagcaaauacagauacuccgagaacaucgagcacaugaacagacaauacuacgcacucccagaaaaccacaaaagcauguccgaacggcuuaaagacauguacguccccacugccguccgacgcgccgucacccgaacuuucgacaucgucaaagaacuaaagaaaauccagggucgagaucccgacaaaauauucauagaaauggcccgcggcaccggugagaccccaaaaggaaaacggaccaacucccgaaaggaccaaauccucgagcacuggcacggacucgauaacaaagacaucaacgaccuaaagaaauccggcauuugggaacaucuggacacgauugacgacgcaaaacuccgcagcgauaaauacuucuuguacuucaugcaacugggccgcugcauguacacugaaaaaccgauccccuucgaggagguagaaaaugagcacaaguggaauauagaccacauauggccccaggccaaaauaaaagacgacucacucgacaacaagguccuagucucaucaaacgagaacggcaagaaaucggacuccuaccccaucagcgaugacaucagacacagcauggccggccuauggcacucccuauauaagaaaggccuaauaucagaaaagaaauaccaacgccucacacgcagcacgccauucaccgacgacgaacucuccggcuucauagcccgccagcuggucgaaacccgccaaagcacgaaagcuguagcaacccuacucaaagaacaauucccuaacaccgaaauugucuacgucaaagccgggcuggucuccgacuuccgccaagagaugggaaugcucaaaugucgcgaggucaacgaccugcaccaugcuaaagacgccuaucuaaacaucguccugggaaacguauacaacacccgcuucacaaaagacccgcucaauuucgucaaaaacaacgaaaaauauagcauaaagaucuuccagaagaacagcgauggaaagaaaacuggcguaaucacucguaaaguagagcggggaggagaggucgccugggauccagagacuagcuucgcuaucguccgcaaaaugaugagcaaaaauagcauccgcuacguacgauacgcauacaugaggaaaucgggccaaaacggcggcuucuucgaccaaaacccacugagaaaaggcaagggcaugguaucuaucaagcacaauuuaagcaucgaaaaauauggcggcuaugacaacgcgacaaucaguuucuuuagccuagucuccauaaaagacuucggcguaauccugcuggcgguugagcugcucagcgcgaacaaauuccucaagaacauaucagaagcgaaggaguacgcagccgauaaacuauccaaggagcucaacgucaagaucgucccgaacgacguagcauucccucucaacaaccgguacaacguaguaaagaucaacgcaguccucgaacuggacggguaccgcguaaugauagccgccaaacagaacaguucaauaaaauucgucucuaacgaaagccugauucucucuagccaacacauggcguaugugaaaaagaucacgaaguucaucgagaagcgaaagcaagauaaggugugcaugaucaacgcuuucuccgguaucucuaucgaagacaauauagaacuuuacgacguucucguaucaaaaugcaacauaaagccauucaacaucauguacgagaaccuaggcauuaaacuuucugacaaccgcgacaacuucauaaagaaauccgucgaaaaccagguacucauccuauccgagaugguacgccucuucaaaacagggcggaaagcaggcguaaaccucgaggagguuggaggaaggaaaaacuccggcgucaaaacacucaacaccugucuauauaaggucaaggacuacucaaauaucuuccugguggaccaaucacccacaggacuaauugaacacaaaucaccgaaccuccuagaccuauga

SEQ ID NO: 6700 - RNA, 4155 nt, Artificial Sequence
  Cas9 variant
augaacaaaccguacucaauaggacucgauauaggcacgaacagcgucgguugguccaucaucacggacgacuacaaaguccccgccaagaaaaugcgggugcuuggaaacaccgacaaagaauacaucaagaaaaaccuaauaggcgcccuccuuuucgacggcggcaacaccgccgcagacagacgccucaaacgcaccgcccggcgcagguacaccagacgacgcaaucgcauccucuaccuccaagagauauucgcugaagaaaugagcaagguagaugacagcuucuuccaccgccucgaagacagcuuccucgucgaagaagacaaaagaggaucaaaauaccccaucuucgcuaccuuacaggaagaaaaggauuaccacgagaaauucuccacaaucuaccaucuccgcaaagaacucgcagacaagaaagaaaaagccgaucuucgccugaucuacauagcucuagcacacaucaucaaauuccgaggucauuuccuaauagaagacgacuccuucgacguacgaaacacagacaucucaaaacaauaccaagacuuccuagaaaucuucaacacaacguucgaaaacaacgaccuccucucucaaaaugucgacguggaagcaauccuaaccgauaaaaucuccaaauccgcaaagaaagaccgcauccuagcacaauacccgaaccagaaaagcaccggaauauucgcggaauuucucaaauuaaucguaggaaaccaagcagacuucaagaaauacuucaaccucgaagacaaaacaccccuacaauucgcaaaagacagcuacgacgaagaucuggaaaaccucuuaggccaaaucggagacgaguucgccgaccucuucuccgcggcaaagaaacucuacgacuccgugcuacugagcggaauuuuaacagucauagaccuguccaccaaagcaccacucagcgcgucgaugauccaacgguacgacgaacaccgggaagaucuaaaacagcuaaaacaguucgucaaagcaucacuaccugagaaauaccaagaaauauuugccgacagcagcaaagacggcuacgcaggguacaucgaaggcaaaacaaaccaagaagccuucuacaaauaccuaagcaaacuccuuacgaaacaagaagacagcgagaacuuccuagagaaaauuaaaaacgaggauuuccuacgcaaacagcgaaccuucgacaacggcagcaucccccaccaaguacacuuaaccgaacucaaagcaaucauuaggcggcaaucugaauacuauccguuccuaaaagagaaccaagaccgcaucgagaaaauacugaccuuccgcauccccuauuacaucggaccccucgcucgcgagaaauccgacuucgccuggaugacacguaaaacagacgauuccauccgacccuggaacuucgaagaccugguugacaaagagaaaagcgcggaagcauucauccacagaaugaccaacaacgauuucuaccucccagaggaaaaagugcucccuaaacacucuuuaaucuacgaaaaauuuacuguuuacaacgaacucacgaaaguccgauacaagaaugagcagggagagacauacuuuuucgacucgaacauaaagcaggaaaucuuugacgguguauucaaagagcacaggaaggucagcaagaagaaacuccuagacuucuuagcaaaagaauacgaggaauuucggaucguagacgucaucggauuggacaaagaaaacaaggccuucaacgcaucucuagguaccuaccaugaucucgagaagauacuggacaaagacuuucuggauaacccggacaacgaaagcauacuggaggacaucguccagaccuuaacccuuuucgaagacagggaaaugauaaagaagaggcuugaaaauuacaaagaccuguucacagaaucccagcucaagaaauuauacaggcgacacuauaccggcuggggccggcucucggcaaagcucauaaacggcauccgcgacaaggagagccagaaaaccauucucgacuaucuaaucgacgacggccgaucaaaucgaaacuucaugcaacucaucaacgacgauggacggucgaaccgaaacuuuaugcaacucaucaacgaugacggccuauccuucaaauccauuauaagcaaagcacaagccggcucucauagcgacaaucugaaggaggucguaggagagcucgcaggaagccccgcaaucaagaaagggauacugcagagcuuaaaaauagucgacgagcuaguaaaagucaugggauacgaacccgaacaaauagucguagaaauggcuagggaaaaccaaaccaccaaccagggccgacgcaauucacgccagcgcuacaaacugcucgacgacggggucaaaaaccuagcgagcgacuuaaauggcaauauuuugaaagaauacccgaccgacaaucaagcacuccaaaacgaacgacuguuuuuguacuacuugcaaaauggacgugacauguacaccggcgaagcgcuugacaucgacaaccucucacaauaugauauagaccauauaaucccgcaagcauuuaucaaagacgauuccauagacaaccguguauuaguuucauccgccaaaaaccggggcaaauccgacgacguccccuccuuagaaauagucaaagacugcaaggucuucuggaagaaacuacucgacgcaaaacuaaugucccagcguaaauaugacaaccuaaccaaagcagagcgaggaggccuuaccagugacgacaaagcccgcuuuauucaacgucagcuaguagagacccgacaaauaaccaaacacguggcacgaauccuggaugagcgcuucaacaacgaacucgacagcaaaggcagacgaauccggaaagucaagauagucacccucaaaucaaaccuagucagcaauuucaggaaagaguucggauucuacaagauccgggagguaaacaacuaccaccacgcacacgacgcguaccucaaugcaguaguagccaaagcaauccugacgaaauacccacagcuagagccugaguuuguauauggcgauuacccuaaguacaacucauauaaaacgcgcaaaagcgccacggagaaacuuuucuucuacagcaacaucaugaacuucuuuaaaaccaaggucacacuagccgacggaaccguaguagucaaggacgacaucgaagucaacaacgauaccggagagaucgugugggacaagaagaaacacuucgcuaccguacguaaagugcuguccuacccgcaaaauaacauagucaagaaaacggaaauacagacagguggcuuuaguaaagaaucaauacucgcucacgguaacucagacaaacuuauaccgcgaaaaacgaaagacaucuaucucgaccccaaaaaguacggcggauucgacucaccgaucguagccuauucaguccuaguaguugccgacaucaagaaagggaaagcgcaaaagcugaaaacagucacagaacuacuagggauuacgaucauggaaagaucacgguucgagaaaaacccgagcgccuuccucgaaagcaaaggcuaccucaacauccgagcugacaaacugaucauccuccccaaauacagccuguuugaacuagaaaacggcagaaggcgccuccucgcauccgcaggagagcuucaaaaaggaaacgaacuggcccuacccacccaguucaugaaauuccucuaccuagcaagccgauacaacgaaucaaaaggaaagccggaggagaucgagaagaaacaggaguucguaaaccaacacguauccuacuuugacgacauacuccaauuaauaaacgacuucuccaagcgggucauccuggccgacgcgaaccucgagaaaaucaacaaacucuaucaggacaacaaagaaaacauuagcguagacgaacucgcaaacaacaucaucaaccuauucacauuuacaagccugggugcaccggccgcguucaaauucuuugacaagauaguagaccgcaaaagauacaccucaacgaaggaaguauugaacuccacacuaauccaccagagcaucacaggccucuacgaaacccgaaucgaccucggaaagcucggcgaagacuga

SEQ ID NO: 6701 - RNA, 4155 nt, Artificial Sequence
  Cas9 variant
augaagcugagaggcauugaagacgauuauuccaucggccucgauauggggaccagcucggucggaugggcggucaccgacgaacgaggcacacuagcacauuucaagcgaaaacccaccuggggcagccgccucuucagagaagcacaaacagccgcaguugcuagaaugccccggggacaacgccgccgguacguccgccgccgauggcgcuuagaccuccuccaaaaacuuuucgaacaacagauggaacaggccgacccugacuucuucauccgccuacgacaaaguagacuacuccgcgacgacagagcggaggaacacgccgacuaccgguggccacucuucaacgacugcaaguucaccgaacgagacuacuaccagcgcuuccccacaauauaccauguaagaucauggcucauggaaacagacgaacaagcggacauaagacucaucuaccuagcccuccacaacauagucaaacaccgcggaaauuuccugagggaaggccagagccuaagcgccaaaagcgcucgaccugacgaagcccucaaccaucugcgggagacccugcgaguauggagcucagaacguggguucgagugcuccaucgcagacaauggauccauacucgcgaugcuaacacacccagaccucucgcccagcgaccgccgcaaaaagaucgcuccccuauucgacgugaaaucggaugacgccgccgccgacaagaaacugggaaucgcccucgcaggagcaguuaucggacuaaaaaccgaguucaaaaacauauucggcgauuuuccgugugaagacaguucgaucuaucucucaaacgacgaagccgucgacgccguaagauccgccugccccgacgacugcgcagaacuauucgaucguuugugcgaaguauacagcgccuacguacuccaaggacuacugucguaugccccggggcaaaccauauccgccaauaugguggaaaaguacaggagauacggagaagauuuagcccuccuaaagaaacuggucaagaucuacgccccagaucaauaccggauguuuuucaguggagccaccuacccagguacagggaucuaugacgcagcgcaggcccgcggcuacacaaaauacaacuuagggccaaagaagucagaguacaaaccauccgaaagcaugcaauacgacgacuuccgcaaggccguagagaaacucuucgcaaaaaccgacgcucgggccgacgaacgcuauaggaugaugauggaccgauucgacaaacagcaauuccuccggaggcucaaaaccagugacaacggaagcauuuaccaccaacuacaccuugaggaguuaaaggcgaucguggaaaaccaaggacgauucuacccauuccugaaaagagacgcagacaaacuugucagccuagucuccuucaggauucccuauuacgucggaccacuaagcacccguaacgccaggacagaucaacacggagagaacagauucgcgugguccgaacgaaaaccgggaaugcaagacgaacccauauucccuuggaacugggaauccaucauugacagaagcaaaagcgcagagaaauucauauuaagaaugaccggcaugugcaccuaccuccaacaggaaccggugcuaccgaaaagcagccugcuauacgaagaguucugcguacucaacgaacugaauggugcccacuggucaaucgacggagacgacgaacaccgauucgacgccgcagaccgagaagguauaauagaagaacucuucagaagaaagaggaccguauccuacggcgacguugcaggauggauggaacgggaaaggaaccaaauaggagcgcacgugugcgggggacaaggggaaaaaggcuuugaaucgaaauuaggcagcuauaucuuuuucugcaaagacgucuucaaagucgagaggcuagaacaaagugacuacccaaugauugaaaggauuauccuauggaacacauuauucgaagacagaaaaauccugagccaacggcuaaaagaagaauacgguagcaggcucagcgcggaacaaaucaagaccaucugcaagaaacgauuuaccggauggggaagacugagugaaaaguucuuaaccggcaucaccguccaagucgacgaagacagcguaucaaucauggacgugcuacgggaaggaugccccgucagcgggaaaagggggcgagccaugguuaugauggaaauccuccgagacgaggaacuaggcuuucagaaaaagguagacgacuucaaccgcgccuucuucgccgaaaacgcccaggcacucggcgucaacgaacugccagggucacccgccguccgacgaucccucaaccaaagcauacgaaucguggacgaaauagccucaauagccggaaaagccccagcgaacauauucaucgaagugacgagagacgaagaccccaaaaagaaaggacgccggaccaaaaggcguuauaaugaccucaaagacgcgcuagaggccuuuaaaaaggaagacccagagcucuggcgagaacugugugaaacagcgcccaacgauauggaugaacgccugucacuauacuucaugcaacguggaaagugccuguauaguggacgcgcaaucgacauccaccagcucucaaacgccgggauuuacgaaguagaccacauaaucccgcgcacauacgucaaagaugacucucuagagaacaaggcgcuaguauacagagaagaaaaccaacgaaaaacugacaugcuccuaauugacccggaaauccgcagacgcaugagcggguacuggcgcaugcuacacgaagccaagcuaaucggcgacaagaaauuccggaaccuccucagaucacggaucgacgacaaggcacucaaaggcuucauagcgcgucagcuaguagagaccggucaaauggugaagcuaguaaggucgcuccuugaagcucgauaccccgaaacaaacauaaucuccguaaaagccagcauaucccacgaccugcgaacagccgcggagcucguaaaaugccgcgaagcgaacgacuuccaccacgcccacgacgcauuucuggcaugccgcgucggccuuuuuauacaaaaacgccaccccugugucuacgagaaccccaucgggcuaucgcagguaguacgcaacuacguccgacaacaggcagauaucuucaaacgaugccgcacgauacccgggaguucaggauucaucguaaauagcuuuaugacauccggcuucgacaaagagaccggagaaaucuucaaagaugacugggacgccgaggccgagguagaagggauccgccgaucccuaaacuucagacaaugcuucauaucacgaaugccguucgaagaccacgggguauuuugggaugcgacaauauauagcccacgcgcgaagaaaaccgcggcccuaccacugaaacaaggguuaaacccgagccgauauggcagcuucucccgagagcaguucgccuacuucuucauauauaaggcgcgcaacccacggaaagagcagacucucuucgaauuugcacaaguccccgugcgccuaagcgcccaaauaagacaagacgaaaaugcccuggaacgcuacgcaagagaacuagcgaaagaccaaggacucgaguucauccgcauagaacgcuccaaaauucuaaagaaccaauuaaucgaaauagacggagaucgcuuaugcaucaccgggaaagaagagguacgcaacgcaugcgagcuagccuucgcccaggacgagaugcgcgucauaagaaugcuaguauccgaaaaacccguuagccgcgagugugugauaucguuauucaaccggauacuccuacacggcgaccaggcgagccgcagacucagcaaacagcucaaacucgcgcuccuguccgaagcguucuccgaagccagcgacaacguccaacggaaugucguccugggccugaucgccauauucaacggcuccaccaauauggugaaucuaagcgauaucgggggaagcaaauucgcaggaaacguucgcauaaaauacaagaaagaacucgccaguccaaaagugaacguacaccucauagaccaaagcguaacaggaauguuugaacgcaggaccaaaauaggccucuga

SEQ ID NO: 6702 - RNA, 4158 nt, Artificial Sequence
  Cas9 variant
augacaaagccguacagcaucgggcuagacauagggacaaacagcguaggcugggccgucaucacggacgacuacaaaguacccuccaagaaaaugaaaguccuuggcaacaccuccaagaaauauauaaagaaaaaccugcucggggcccuccuguucgacuccggaauaaccgccgaaggcagacgccucaaacgaaccgcccgucgccgcuacacccgccgucgcaaccgcauccucuauuuacaggaaaucuucuccacggaaauggcgacccucgacgacgccuuuuuccaacggcucgaugacagcuuccuaguaccagacgacaaacgagacuccaaauaccccauauucggcaaucuuguagaagaaaaaguguaccacgaugaguucccaacaauauaccacuuacgcaagcaucucgcagacucgucuaagaaagcagaccuucggcuugucuacuuggcacucgcgcacaugaucaaauaucgaggccacuuccuaauagaaggggauuucaacuccaaaaauaaugaccuccagaaaaacuuccaagacuuccucgacaccuacaacgccaucuucgaaagcgaccucagccucgaaaacaguaagcaacucgaagagaucguaaaagacaaaaucucaaagucagcuaaaaaggaccgcauccuaaaacucuuccccggcgagaagaacuccgguaucuucucggaguuccuaaaacuaaucgugggcaaccaagccgacuucaggaaauacuucaaccucgacgaaaagaccagccugcaauucuccaaagagucauacgacgaagaccuagagacccuguuaggccacauaggagacgauuacuccgacguauuucucaaagccaagaagcuauacgaugccauccuccugucggguauacucacgguaaccgacaacggaacagaagccccgcuauccucugccaugauaaugcgauacaaagaacacgaagaagaccucgcacucuugaaggcuuacauacgcaauaucagucuggaaacguacaacgaaguauucaaagacaauaccaagaacggcuacgccggcuacauagacgggaaaaccagucaggaagacuucuacguauaccuuaaacgccuccucgcaggacucgagggugccgacuacuuccucgagaaaaucgacagagaagacuuccuccgcaagcagcgcaccuucgacaacggauccaucccuuaccaaauauaccuucaggaaaugcgggcaauccucgacaagcaagccaaauucuaccccuuccuugccaaaaacaaggaacguaucgagaaaauccugacauuccgaauaccauacuacgucggcccccucgcacgaggaaacucugacuucgcguggucgauaagaaagcggaaugaaaagaucacaccauggaacuucgaagacgucauugauaaggagucaagcgccgaagcguucauuaaccgcaugaccagcuucgaccucuaucuccccgaagagaaaguccuucccaaacacucacuccucuacgaaaacuuuacuguuuauaacgagcuaaccaaaguccgauuuauagcagaaggcaugcgggacuaucaauucuuagacuccaaacagaagaaagacauuguccggcuuuacuucaaaggcaaacguaaaguuaccgacaaagacauaauagaauacuuacacgccaucgacgguuaugacggaauagagcuaaaggggaucgagaagcaguucaacagcucccuuucaaccuaccaugaccucuuaaacaucaucaacgacaaagaguuccucgacgacuccuccaacgaaacgauaauugaagagauaauccacacccugaccauguucgaagaucgcgaaaugaucaaacaacggcucucgaaauuugacaauauauucgauaagucgguccuuaaaaagcuaagcagacgccacuacacaggcuggggcaaacucagcgccaaacucaucaacggcauacgggacgagaaaucuggcaacacuauucuagauuaccucaucgaugacggaguaucuaauagaaacuucaugcagcuaauccaugacgacgcccucuccuucaaaaagaaaaucaagaaagcccaaauaauaggugacaaagacaacauaaaacagguagucaaaagccuaccagguucccccgcgaucaagaaaggaauacuacaaucaauuaaaaucguggacgagcuaguuaaaguuaugggacgcgaacccgaaucuaucguuguagaaauggcgcgggagaaccaauacaccaaucaaggaaaaagcaacucccaacaacgccucaaacgccuagaagaguccuuaaagggccuaggaagcaaaauccucaaggaaaacguccccacacgccucagcaaaauagacaacaacgcuuuacagaacgaccggcuauaccucuauuaccuccagaaugggaaagacauguauacaggcgaagaacucgauaucgacagacucagcaacuacgacauugaccacaucaucccccaagccuucuuaaaagacgacagcauagacaacaaaguucucguaagcagcgccaguaaccgcgguaaaucagacgacguaccaagccucgaaguagugaagaagcgaaaaacccuaugguaccaacuacuuaaaagcaagcucaucagccaaagaaaguuugacaaccuaaccaaagccgaacgcgggggccuaucccaagaggaaaaggcgggcuuuauccaacgacaacuggucgaaacacgccagauaaccaagcacgucgcccggcuacucgacgagagauucaacaacaagaaggaugaaaacaaccgcacgcucagaacagucaagauaaucacccucaaauccagccuggucucccaauuccgcaaagacuucgaacuauacaaagugcgggaaauaaacgauuuccaccaugcacacgacgccuaccucaaugccgucgucgccagcgcgcuucuaaagaaguauccgaaacuagaaccggaguucgucuacggcgacuacccaaaauacaacuccuuccgugaaaggaaaagcgccaccgaaaaaguguacuuuuacucaaauauuaugaacaucuucaagaaauccaucccccuggcagacggcaccgucauugaccggccccucaucgaaguaaacgaagaaaccggagaaucaguauggaauaaaguagccgaccucaacaccguccguaaaguccuaaguuauucucagguaaacaucgucaagaaagucgaggagcaaaaccacggguuggaccgcgggaaaccuaaaggccuuuuuaacgcaaaucuaucauccaaaccgaaacccaacuccaaggaaaaucucgucggcgccaaggaguaccuagaccccaagaaguacgggggcuaugcaggcaucuccaacagcuucgcgauucuugucaagggcaccauugaaaagggcgccaagaagaaaaucacgaacgugcucgaguuccagggaauaucuauacucgacagaaucuacuaccgcaaagauaaacuaaacuuccuacucgaaaaaggcuacaaagacaucgaacuaaucauagagcuccccaaauauucacuguuugagcucagcgacggcagccgaagaaugcucgccuccauccuauccacaaacaauaagcgcggagagauacacaaagggaaccagaucuucauaucacagaaauucgucaaacuccucuaccacgccaagcgaaucucaucaacauucaacgaaaaucaccguaaauacguugaaaaccauaagaaagaguucgaagaacucuucuacuacauccuagaguucaaugaaaacuaugugggcgcuaagaaaaacggcgagcuacucaaauccgcauuccagucguggcagaaccacaguauugacgaacuuuguuccuccuucaucggacccacgggaucggaacguaaaggccuguucgaacuaacaucacgaggcggggcagcagacuucgaguuccucggagugaaaaucccacgcuaccgcgacuacacccccuccucccuucucaaggacgcaacacucauacaucaauccgugaccggccuguacgaaacgcgcaucgaccucggcaaacucggcgaagacuga

SEQ ID NO: 6703 - RNA, 4158 nt, Artificial Sequence
  Cas9 variant
augcaaacauacuucggcaugaagaaaauccucggccuggaccuaggcacaaacucuaucgguugggcucugguaaacgaagcgaacgacgacaacgaaaagagcucuaucaucaaacucgggguucgagucaacccucuuacggucgacgaacaaucaaauuucgaaaagggcaaaagcauaaccaccaacgccgaacggaccauaaaaaggucgauccgaagaucacuccaacgguacaagcugcgucgcgaaaaccucaucgaaauacugaaggaacauaacuucauuaccgacgacacgauacucucagaagauggcaacgcuuccacguucgaaaccuaccggcuccgagccaaagccgcguccgagaaaauaucccuggaagaacuggggcggguccuacucaugaucaacaagaaaagaggguacaaauccagccgaaaagccaaaaaccaggaggaggggcagcuaauugacggcauggaggucgcaaaggaacuauacgagaaaaacaucacacccggacaauucguuuuccagcuccucaagcagggcggaaaauucauccccgacuucuaucgaucggaccuccaggcagaguucgacaagauuugggaguuccaaaagcuauuccacgcagaaauccucguggacgacuucaagaagcagcuagaacggaagggaaaacugaacagcucuaagaucuuccuaggacgauucggcauuuacacugccgaaaacaagggcaacgacaaacgccuccaagcauaccaguggcgaguagacgcccuaacuaaagaacucacaaaagaagaacuagcauacguaauauccgaccugaacgggauaaucuccagcagcagcggauaccucgggagcaucucugaccgauccaaagaacucuacuucaacaaccagaccgucgggcaauuccuuauggcccaacuggaccacagcccccacaccucccugaaaaaucaagucuucuacaggcaagacuaccucgaugaguucaacacccucugggaaaaccaagcccacuaucacaagguacuaacgagugaccucaaauccgaaauccgcgacguaaucauuuucuaccaaagacgccucaagacccaaaagggacucauaucguucugcgaguucgaaucgagaaaaauagaaguagaaauagacggaaagaaaaagauaaagaacgucggaucacgagugugucccaaaucaucacccauauuccaagaguucaagaucuggcaaauucucaacaacauagagcuccuugagaaaagcagcaaagccaaacgcuuccucgaccaggaggagaaagagcuacucuucaaagaacuauccauaaaguccaagauauccaaaucggacgcgcucaaacugcuguucaaaaacagccgcgaacucgaccuaaacuacaaagaaaucgaagggaaccgaacccagagcgcccucuucgacgcguauucaaaaauaaucgagcuauccggccacggagaauacgacuucuccaaaauggaggccagcaacauaaucgagcuaguacaagaagucuucaccgggcuaaacuacaacacagagauacucuacuucgacucgagucucgaagggaaagacuucgaaaaccaacccauguaucgccuauggcaucuacuauauagcuucgaaggagacgacuccaaaacaggcaaugaaaagcucaucaacaaauuaucagaacuauacggguucgaaaagaaguacucgauuguccuagccaacguguccuuccaagaagauuacggaucauuaucgaccaaggccauacgaaaaauccaccccuaccuaaaggagggcauucaauacgacguugccugcgaauuugccgguuaccggcacucaaaaucuucgcuaacgaaagaagaaaucgaaaacaaaauacucaaagaccaacucgagauacuccccaaaaacucacuucggaacccagugguagagaagauacucaaccaaaugaucaacguaguaaacgcgcucaaugaguccuacggcaagccugacgagauacgcauagaacucgcacgagagcuaaagaaaagcgcaaaagagagggaggaacugacagccuccauaggagaaaccacaauaaagcacgaaaaauaucgggcaauacuagaaaaugaguucgggaucucgcacguaagcagaaacgacauaauccgcuacaagcuguaccucgaacuagaaaaucgcggcuauaagacguuauauagcaacaccuacgugagccaagaaaagcuguucucaaaagaauuugacaucgaccacaucaucccgcaaagcugccuguucgacgacucguuuucgaacaaaacccucgaaucgaagucaguaaacaucgaaaagggaaacgacaccgcguucgacuacguguucgcgaaauacggagaagcgggacucucugacuacaucauucacaucgaggaacuguuuaaggacggcaagauaucgaagacaaaacucaauaagcucaagaugaaaggcaacgaaauaccaucagacuucauugcgcgcgacauucgcgacacccaguauauagcacguaucgcaaagaacauccucgaagaaaccgucaggaacguggucuccacuuccggaagcauaacugacagacuacgcgaggacuggcaacucaucgacguaaugcaggagcuaaacugggagaaauacuccgcccugggccugacagaaauauaugagaauagagagggacacacaauucgccgaauuaaagacuggacaaaacguaacgaucaccgccaccacgccauggaugcccucaccaucgccuucaccaaacgaucccacauacaauaccucaacaaccugaacgcacggucagacaaguccggcucaaucuacgggaucgaaaccaaggagcuauauagggacgaccacgguaaacugaaauucaaacccccaauaccgcugaacgaguuccgagcugaagccaaaaagcaccuagagaacacgcuaauaucaaucaaagcgaaaaacaagguggccaccaucaacaucaacaccacaucaacaaaggaaggcaagaacaagaaacgacaacuaaccccacgaggccaacuucaccuugaaaccauauacgguagcauccaacaauacgucaccaaacaagaaaaaguuggggccucauuuaacgaagaacaaaucagcaaagucgccaaacaaaaauacaggcaagcccugcuaaacagacuccgcgaguucgacaacgacccaaagaaagcguucacgggaaacaacaguuucgagaaaaaccccauauaccucgacguacuucagacccagaaagugcccgauaaaguggagaccguuagcaaagagaucauauacacgauacgaaaagacaucaccccagaacucaagauagaaaagguuaucgacaaaaagaucaagacaauacugcaaucccgacugaacgaguacucuggcgacuccaaaagagccuucuccaaccucaaagagaaccccaucuggcucaaccaagaaaaagggauagaaauaaagcgggucaccaucucaggcaucucaaacgcgguagcaauccacgacaagaaagacaaaaacggcaaccucaucuuggauaacgaagggucuacgcaggcaguagacuucguaaacaccggcaacaaccaccauguagcuaucuacaaagacgagcgcggcaaccuccacgaauccguagucuccuucuuugaagcaugcacccgcgucaaucucggaggacccguaaucuucaaaaacuacaacaaguccgacgggugggaguuccuguucucgaugaagcaaaacgaauacuucguauuccccaacgagaaaacaggcuucaacccaaacgaaauagaucuccucgacccggacaacuacagacuaaucagccccaauuuauuccguguacagaaaauauccagcaagaacuacguguucaaccaccaucuagaaacaucagcaaucaccggagaaacgcucaaaaauaagaaacaacuuuccuccguaaccuaccacuucauucaaagccuacccccaaucaaagacaucguaaaaguccggauaaacaacauaggacaaaucguguggguaggagaauauuga

SEQ ID NO: 6704 - RNA, 4158 nt, Artificial Sequence
  Cas9 variant
auggacgaacuccaaaacuuugaaaaagggaaaucgaucacaaccaacgcggaccgcacagcgggucggagcaugagacggaaccuacagcgguacaaacucagaagagaaaaccucaucgaaguccucaaagaguacaacuucaucaccgacgaaaugauauuauccgaaaacgguaaucggacuacauucgagacauaccgccuucgagccaaggccgcggucgaggaaaucucacucgagcaauucgcaaggguccugcugaugaucaacaagaagcggggguacaaaagcucucgcaaagcgaaaggcgccgaaaauggaacccuaauugacggaauggaaguagcaaagaaaauguaugacgaaggcauaaccccaggggaacuuugccuacagcuccucacagccggaaaacgguacuucccagacuuuuacagaagcgaccuacaggccgaguucgaccgaauauggaacuuccagaaacaauucuaucccgacucccuaauagacaaggugaaggacgaaguacgcggcaaaaauaagucucagacaugggcaauuuuggccaaguacuuugucuggaaagaagucgaaaacucauggaacgaagaagaagcccagacacgccgagucgaaaaagaguaccgucuagucggaauaaagagaggagucaagcgggaagaacucaaacucgagaacuuccaauggcggguuaaagcccuaucagaacgcaugaaccccgaagaacuagcaaucguacuacaagaaauaaaugaacagaucucaaauucgagcggauaccuaggcgccauauccgaccgcagcaaggagcucuacuuuaaccgccagaccguaggacaauaccaaauggcggugcuagacaacaacccaaacauaggcuugcgaaacaugguauucuaccgccagggguaucugggcgaguucaauaccaucugggagaagcaagcagaguuccacaaagagcuaaccgaggaucuuaagaaagagauacgggacaucgucauauucuaucaaaggcgauuaaaaucccagaagggccuuaucaacaucugcgaguucgaaagacgacaaauugaaguggaaaucgacggcaaaaagaagaucaagaccauuggaucccgagucaucccccgaagcucgccacucuuccaggaguucaaaaucuggcagacccuuaacgacaucgaaguauccguacucggcguaaagaacaaacggaagaagcaggacgacaacucaacaacgcuacucgacucggcagaaaacauagacagccuaaaacucaacguaagcaggccccucgacgcggaugagaaaagccuuuuggcuaaagaacuauuuaucagagauaaacuaacaaaauccgacguccucaaacuacuguucaacaacccccaaaaccuaaaccugaacuucaagaacaucgacggaaaccgcaccggcucagcccuauaccaggcauucuccaaaauacuagaaauauccggacacgaaagcauaaacuuuaagaaauccgcagacgaaauaguagaacaagucaaaaccaucuucucagcccugggguggaacacagaagugcucugcuucgacagcgaaaaagaacuggacaaacaaccguacuucaaacuauggcaccuccuauacucguucgagggggauuccacaccuacgggagacggaaaccuaauucagaaaaucgcagaccugugcggcuucgagaaggacuacgccagcaucuuagcgaacauaacauuccaagaagacuacggcagccucucaaccaaagcaauacggaaaauacucccacaccucaaagacgggaaucaauacgacgucgccugcgaauaugcgggcuacaaacauuccaaauccucccucaagaaagaggaaaucaaaaacaaaguauugaaagauaaacucgaacuacuccccaagaacucgcuccgcaaucccguaguggagaagauccucaaucaaauggucaauguaauaaacgcaaucauaaccacguacggcaaaccagacgaaauccggaucgaacucgcucgcgaacugaaaaagaaagccaagaaacgagaagaacucaccaaaacaauuguggacacaacaaaaacgcacgaaggcauacgagcaauccugcaaaacgacuucggcaugucccaugucagcagaaaugccaucauacgauauaaacucuacgaggagcucaaagacaacgguuacaaaacgcuuuacagcaacaccuacauccccaaagaaaaacucuucagcaaagacuucgacauugaacacauuaucccgcaagcgcgacuauucgacgacagcuucuccaacaagacccuggaaguaaagagcauaaacaucgagaaaggcuccaagacagcauacgacuucguagaagagaaauauggggagcaaggucuacaagaguaucucaacagaugcgaaguucuauuccgagacaaaaagaccaaacugcguaaacugaaaaugcaagaauccgaaauccccgagggauucaucgaccgugaccuucgaaacacacaauacaucgccaagaaagcccucagcaugcucaacgaaauaugccgcaggguuguggccaccaccggagccauaaccgacgaauuacgcgaggacuggcaauuaguggacgucaugaaagaacucaacugggaaaaauauaaaguacucggccuaguagaguacuucgaagacaaugacggacgccucauagggcgcaucaaagacuggacgaaacgcaacgaccaccgucaccacgccauggacgcauuaaccguagcguucacgaaagacgucuucauccaguacuucaacaacaaaaacgcaagccuaaagcccgacaccaacgaggccgcuauacgcaacaaauacuuccaaaacggcaaggcaaucccaccgaugagccuggacgaguuccgagccgaggccaagaaacaccugaacgacacccugauaagcauaaagacaaagaacaaaguaguaaccaucaaucuuaaccggaccaaaaagaaaaacggaaucaacaagaaacagcaacaaacgccccgcggacaacuacaccuggaaaccgucuacggaucucacaaacaauacgucgucaaagaggaaaaaguaaacgcauccuucgacgcggcaaaaaucgccaccgucaacaaaccagcguaccgugacgcccuccuccgcagacugcaagagaacggcaacgauucgaagaaagcauucaccggcaaaaacagucuagacaagcagcccgucuggcuggacgccaaacagaacgaauguguccccgaaaaggugaaaaccgucaugcuagaaacggucuauaccguccggaagcccauagacgagaagcucaacgucgacaaagucguagacgcaaggauacgaaagcuacuacaagacagaauaaaggaauacggaaacgccaaauccgcguucgccaaccuugacgagaacccaauauggcucaacaaagaaaaaggcaucaccaucaaacgcgucuccgucuccggcauaucaaaggcccagagccuacacgaaaagaaagacaaagacggcaacuucauccuggacaaagacucccgacgcauaccaguagacuucguaaacacgggaaacaaccaccacgucgcuauauacagaaagcccguacucgauaagaaaggccaggccguauucgacgaaaacggcgaauuaaaauuugagcucgaagaggucgucguuuccuuuuucgaugccgucacccgcguuaaccucucacagccaauaauagacaaagacuauaagcgaucggaaggcuggaaguucuuauucucaaugaaacagaacgaauacuucguauuccccaacgaaaagacaggcuucgaccccaaagagauagaccuacucaauccggagaacuacgcccucauaucccccaaccucuuccgcguacagaaaaucgccagcaaagacuacguguucagacaccaccuagagaccgucgucgccgacagaaaagaacugcaagaaauaacuuggaaacggaucucaucauuaucuauccucaacagaaucauaaaggucagggugaaccauauuggccagauaguaaugaucggugaguacuga

SEQ ID NO: 6705 - RNA, 4158 nt, Artificial Sequence
  Cas9 variant
augacuaaaccauauagcauaggccucgauaucggaacuaacagcguuggaugggcaguuaucacggaugacuauaaaguccccucaaagaaaaugaaaguucucggcaacacauccaagaaauauauaaagaaaaaccuacucggagcucugcucuuugacagcggaauaaccgccgaagggcgaaggcugaaaagaaccgccaggcgcagauauacgcgccgucgcaaucgaauccucuaccuucaagaaaucuucuccacugaaauggccacacuagaugacgcauucuuccagcgccuagacgacagcuuccuaguccccgacgacaaacgggacuccaaauacccuaucuucggcaaccucgucgaggaaaaggcuuaccacgacgaauuuccuaccauauaccaccuacgaaaauaccuagcugacuccaccaagaaagcagacuuaagacuugucuaucuagcccuggcccauaugaucaaauaccgaggccacuuccugauagaaggcgaguucaacagcaaaaacaaugacauucaaaagaacuuccaagauuuccuggacaccuacaacgccaucuucgagucggaccuaucgcuagagaacucaaagcaacuugaggaaaucguaaaagacaaaaucucaaaauccgcgaagaaagaccggauucucaaacuauucccgggagagaaaaauucgggcauuuucuccgaguuccugaaauuaauaguaggaaaccaggccgauuucaagaaauacuucaaccucgacgaaaaagccccacuccacuuuagcaaagaauccuaugacgaggaccuagaaacgcuccucggauacauaggagacgacuacucggacguauuuuuaaaagccaagaaacuauacgacgcgauacugcucagcggaauacucacaguaacggacaacggcacagaagcuccccucuccucagccaugaucaugcgcuacaaggagcacgaggaggaccuagcgcugcucaaggcauacauacgaaacauaagccuagaaacauacaacgaggucuuuaaagacgacaccaagaauggauaugccggcuacaucgacggcaagaccagccaggaagacuucuacguacaccucaagaaacuucucgucggccucgaaggcgcagacuacuuucuagagaaaaucgacagagaagauuuccuccguaaacagcguaccuucgacaacggcagcaucccguaccaaauucaccuacaggaaaugcgagcaauacuggacaaacaggccaaguucuacccauuccuggccaaaaacaaggaaagaauagagaaaauacucaccuucagaaucccauacuacgucgggccauuagcacgaggcaauucggacuucgcaugguccauuaggaagcggaacgagaaaaucacccccuggaacuucgaagacgucaucgacaaggaaucaucagccgaagcauucauuaaccgaaugaccucauucgaccucuaucuucccgaagaaaagguccucccaaaacacucacuacuauacgaaaccuucaaugucuacaacgagcucacaaaaguccgauucauagcggaaucuaugcgcgauuaucaauuccuugacagcaagcagaagaaagacauagugcgccucuauuucaaaaacaaacgcagaguaaccgacaaagacaucauugaauaccuccacgccaucgacggcuacgacgguaucgaacucaagggcaucgagaagcaguucaacaguucccucagcaccuaccacgaccuacucaacaucauaaacgacaaagaguuccuagacgacucaaguaacgaagccauaauagaagagaucauucacacccuuaccaucuucgaggaccgcgagaugaucaagcaacgacuauccaaauucgaaaacaucuucgacaaguccguccucaaaaaguuaucacgacgucacuacacaggcugggggaaacuaagcgccaaacucaucaacggcauccgagacgaaaagaguggcaacaccauccuagacuaccucaucgacgacggggucuccaaccgcaacuucaugcagcucauccacgacgacgcacucuccuucaaaaagaaaaucaagaaagcccaaauaaucggcgacaaagacaacauaaaacaggucgugcaagccuuaccuggcaggccagccaucaaaaagggaauacugcaaagcauuaaaaucgucgacgagcuaguuaaggucauggggcgccgaccugaaagcauugucgucgagauggcccgggaaaaccaguacacaaaccaaggaaaaagcaacucgcagcaacgucuaaagcgccuggaagagagccucaaagaacucggcagcaaaauccugaaagaaaacaucccagccaaacuaagcaaaaucgacaacaaugcccuacagaaugacagacucuaccuauacuacuugcagaaugggaaagauauguacacaggagaagaacuugacaucgaucgacuaucaaacuacgacaucgaccacaucauaccacaagcauuccuaaaggacaacucaaucgacaacaagguccucguaucaucagcaaguaaccgcggaaaaucagacgacgucccuucacuagaaguaguaaagaaaaggaaaacccucugguaccaacuccuuaaaagcaaacuaauaucgcaacgaaaauucgauaaccuaacgaaagcagaacgaggaggccucucaccagaagcgaaggccggauuuauacaacggcagcucgucgaaaccaggcaaaucaccaaacacgucgcccgccuucuagacgagcgauucaacaacaagaaagacgaagacaacaaaacacugcgaaccguaaaaaucaucacacuaaaaagcucacucguaucccaauuccgaaaagacuucgagcucuauaaagugcgagagaucaaugacuuccaccaugcacacgacgccuaccuaaacgccguagucgcaucggcacuccugaagaaauacccgaaacucgaacccgaguucguuuacggggacuacccaaaauacaacuccuuccgggagagaaaauccgcaaccgaaaaagucuacuucuacucaaacauaaugaacaucuucaagaaauccauuucccuggccgacggaacugugaucgaacgaccacugauagaagucaacgaggagaccggagaauccguuuggaacaaaguagcagaccucaacaccguccggaaaguccuaagcuacucccaagugaacaucguuaagaaagucgaggaacagaaccacggccuugacagaggaaaaccgaaaggccucuucaacgcgaaccuaagcuccaaacccaaaccgaacucgaaagagaaccucgugggggcaaaagaguaccuggaccccaagaaauacggaggauacgcuggcauuuccaacagcuuugccguucucgugaaaggcacaauagaaaaaggugcgaaaaagaaaaucacaaacauccuugaauuucaagguauaagcauucuggaccggauaaccuaccgcaaagacaaauuuaacuuucuccuagagaaaggauacaaagacaucgaucucauaauagagcuacccaaauauucucuguucgagcucagcgacggcucaaggcgcaugcucgcuucaauccucuccacaaacaacaaacgaggggaaauccacaaaggaaaccaaaucuucauuagccaaaaauacguaaaacuccuauaccacgccaagaggaucuccaacacguucaacgacaaccaucgcaaguacguugaaaaccacaagaaagaguucgaggaacuguucuacuacauacucgaguucaacgaaaacuaugucggcgcaaagaaaaacggcgaauugcuaaaaagcgcguuccaaagcuggcaaaaccacagcauugaugaauugugcuccagcuucaucggccccacagggagcgaaagaaaaggucuauucgaacucaccucgcgcggaggugcggcggacuucgacuucuuagguguuaaaaucccccgcuaccgggacuacacucccagcucacuccuaaaagacgcaacacugauacaccaauccguaacaggccuguacgaaacucgcauagaccucgggaaacucggagaagacuga

SEQ ID NO: 6706 - RNA, 4158 nt, Artificial Sequence
  Cas9 variant
augaaaaacaaaacaugguaucuuggacucggcguuggcccaacaucaaucggcugggcugccaccgacuccaacuacaaauugcugcguaaaaacaagaaacgguuguggggagucagacucuucgaagaggcaaagacugccgucgaccgacgaacauuucgcgccgaacgccgacggcuggcccgaagaaaauggcgaaucagcuuauuagaagaacuauucgcgaaagaggucuccaaaaacgacccaaacuucuuccuccgccuuaaggagucaaaauaccacuucgaggacaagucauugaugaacgaguacauacuauucaacgacaaagacuacacagacaaggacuauuacaaagaguaccccaccauauaccaucuacgccucagucuaacgaccgaggagaauccagacauccguaaagucuaccuagcgguucacagcaugcucaaaaaccgcggacacuuccuacuacaaggacagagcuucaacgacagcaacaucgacucggucaucaaggaacuccuugagcucgagaccgucaaaauaaacuucgaaguaacagacgagguaauacacagucugaaaaagaucgcucuggagaaaaagaaccuuuccgacaagaacaaugauguaaagaagcuauacccaaaagaaaaacaacugcaggaaaucuucaagcuagucuucgggggaaagaccagccucgacaaacuauacgacaucgaagaauacaaggaacucgacaacucaguaaaguccauauccuucaaggaaaaaguauacgaagaaguccgcccagacuacgaacaaauccucuccaauuacauagagcuccuggaucucgccaaacuuguuuacgauagcaucguacuggccgacauaaagaaagaagggaagaccauaagugaaaguaaggucgagcucuauaauaagcacaaagacgaccucgcgaaccuaaagaaauuaguaaaaaucgacuccaaacuauccgaagacaaaaagaaggaagucuacuucacgauauucaaagaagacaaagagaaaggaacaaacuacgugaacuacacccaccgcucccaggaaggaaagagcugcucauacgaagacuuuaagaaguuccucaaaaaggagcucgagaaauuagaggauagcccaaccaaaaccaccauucuggaggaacucgaccucgagacuuuccucccccuacaaagaacaaaagauaacucaguggucccauaccaaauacacaaggaagaacucgugaagauucuagacaacgccgccaaauaccauucauuccuugcugagaaagacgacagcgguuacucaacacgcgaaaaagugguccagcuauucgaguucagaauccccuauuacaucggaccccucaacgcacaccacaacaccgagaacgggggcuacuccugggcaaucagaaagaaaggaauggaguccgugcccgucacgccguggaacuucaaagacgucauagacgagagcgcgucagccgaagccuucguaaauaaccucaaaaauaagugcgcuuaccuguccggagaggacguccugcccaagaacucucugcuauacucagaauacgcucugcucaaugaacuuaacgcccuccgauacgaagguaaccguauaagcgucgaagcgcgagacgucauagucaccaaacuauucaaagaacaaggcaaaaaggucaccaagaagacgauaaaagagcuccucaagaccgaaggguucauagacggcaaaggagaaaucguuggcauagacaacaucgugaaaaacgaccuaaaaagcuacagggacuucaagaagauacucgcugacaaauucgacaaagaaagagucgagaacauuauacuguggauaacgcucuauggggaaucccgcaagcugaucaaggagaaaaucaccaaaguguacggcgacuucuacacagucgacgagauagagaagaugucuaggcuuacauauaaggacugggggauacucucccgaaagcugcuuacggagcuagucuccgaaaagcuauacaacgaagaaaccggcgaaugccucaacauuaucggcgcgaugcgacaaggcaccauccuguucauggaacugcucgcugacaaguuugauuauaugagccaaaucaaaaaccacaacaaggaaaacaaggacgacauaacagaaaucacgccggacauccuugagaaccugcacgcgaguccugcugucaaacgcucaaucuggcagacaguccgcauuguagaggaacuaaaaaccauaauaggcugugucccgaccaagaucuucaucgaaaccacgaagcggaacaaugcacccuauaaaguuccgacccuaaaccgaaacgaccucgucaccaaguacaaaacgauaagggaacacgaaaucuucgagcucgaaaaagagcuuaaaaauacccuagauuucacccuaaauaaaaaccggcucauaaacgaggagccaucaaagcucaaagcuacgaaacucuaccuauacuacacacagcucggacgcuguauguacacggguaagaaaaucgauuuaggagaacucuuugacaacaacaacaaguacgacauagaccacaucuacccacaauccaaagugaaggacggguccuuuaacaauauaguccuaguaaccaaggcgagcaacgacaugaaagccgacguguucccacuuaagucaaaauuucagaccaaggaaaacaagaucuucuggagguuccucaaagaaaagaaacucaucacagaagaaaaauauaacaggcuagucagaaccgaagaguucucgaacggggaacucacgggguucaucacccggcaacucgucgaaacaucgcaagccauaaaagucaucagcaacguccuccgagaguugaaccccgaaaccaccaucugcuacagcaaggcagagaacgucucauccuuccgccagaguuucggcaaaauaaaagaagcgaaccgcaaagcggaaaacaacgaaaaacuaauccggguacaggaaauuaaugauuacuacaacgcaaaagacgccuaccuuuccaucgugguagggaacgucuacgacgucaaauucacgcgaaacguccauaacuucaucaaaaacaacaaagacgccagacgguacagccugaacggccuauuuuacaccgacgugaagaacgcaaacacuauagccugggaaauggacaaaaccguucacguagucgaaaagaccaugaacaacaacaacauacugauaacccgucgaacauccgagcaaaaaggagcacucuaugacgcaacacuguacaaagccaaagucgccgagaaagccaaggaaggaacuuacuacccauuaaaaacaacggacucuaaaauaaaagacguggggaaauacggcggguucacaaaaaucaaaaucgcguacuacuccaucuucgaguacacccucgaugguaaaaagggaaagcagaaaauaacacgcaucguacccaucccgaucuacauaagccaaaacauaaaagacgacaaggcccuccuugaauacgcgcagacucggcucccggggaaagaccuaaaaauaaaguaccgcaaacucugcaucgggagccuagucaaaaucaacaacuucaacuacuacauagggggaaaaacaaacaacaacuucaccuucgacucagccguccaaguuauauuggauaaggacucagaaucguacaucaaggagcuugcgaaauaccugaauuggaagaaagaaaacaaagauggaaagcugugggaaagcauaaccgaagacaaaaacauccaacucuacgacucauuagucaaaaagaugaacaccggcauauucauucgcaagaccccgaacaaguacacagaacuccucacccucgaaguaaagaacaaguucauaaacaucgacauagacgagcaaguaaaacuccugcuggaaauacugaaccuccucaccaauaagaaauucaccagcaaacuaaacgagaucggcaucaccgcauccaggggcguaugcagcuucaaccuuucuaaucagucgcaguucuccaucaucgaacaaagcguaacaggcguauaugagaaagaaaagcucauaaucgagaagaaaaaggagggaauccuguga

SEQ ID NO: 6707 - RNA, 4161 nt, Artificial Sequence
  Cas9 variant
augaaccagaaauacagcaucggacuagacaucggcacuaacuccguggguugggcugucauaaccgacgacuacaaggugccagccaagaagaugaaaguacugggcaacacagacaagcaaucaaucaagaaaaauuugcugggcgcacucuuguucgacaguggagagacggccgaagcaacuagacuaaaaagaacugcacgcagacgauacacuagacgccggaaccgccuccguuaccugcaggaaaucuucgcagaagagaugaugcaaguugacgagagcuucuuucaacgacuugacgauucguuccucguugacgaagacaaacgaggcgagcggcaccccaucuucggcaacaucgcggccgaagucaaauaccacgacgaguuucccaccauauaucaccuccguaagcaccucgcugacauuucucagaaagccgaccuccgacucguuuaccucgcucucgcgcacaugauaaaauuccgggggcauuucuugaucgagggccagcucaaggccgaaaacacaaacguucaagcacuuuuuaaagacuucgucgaaguauacgacaagacaguugaggagagccaucuaucggaaaucaccguagacgcgcuaucuauacuaacugaaaaagucuccaaaucccgacgccuagaaaaccucauagcacacuacccugccgaaaagaaaaacacacucuuuggcaaccugauagcacuauuccuaggacuacagccaaacuucaaaaccaauuuccaacucagcgaggaugccaaacuccaguuuaguaaagacacauacgaagaggaccucgaaggacuacucggagaggucggcgacgaauacgcggaccucuucgccagcgccaaaaaccuguacgacgccauacuccuaagcggcauccuaacuguagacgacaauuccacaaaggcaccccucucggccucgaugguaaaacgauacgaagaacaccagaaggaccucaagaaguucgaggacuucauaaagguaaacgcccuggaucaauacaacgccaucuucaaagacaagaacaagaaaggguacgcagguuacaucgagagcggcgucaaacaagacgaguucuacaaauaucuaaaaggcauacuccugcaaaucaacggcucaggcgauuuccuagacaaaaucgacagagaagacuuccuaagaaaacagcgaacguucgacaacggcuccaucccgcaccaaauccaucuacaagaaaugcaugcaauccuccgccgacagggcgagcacuaccccuuccucaaagaaaaucaggacaagaucgagaaaauacuaacauuuaggauaccguacuaugugggaccauuggcccgcaaaggcagccgcuucgccugggccgaauacaaggcggaugaaaagaucacccccuggaacuucgacgacauacuagauaaggagaaaucagcagaaaaauucauaaccaggaugacacucaacgaccuguaucugccugaagaaaagguguugccgaaacacucucuccucuacgaaacauucaccguuuacaacgaacuaacaaaagucaaauacguaaaugaacaaggcgaagccaaauucuuugacgccaacaugaaacaggaaauuuucgaccauguguucaaggaaaaccgaaaaguaacgaaagacaaacuccuuaauuaccuaaauaaagaguucgaagaguuccgcauugucaaccuuacagggcuggacaaggaaaacaaggucuucaacucuucucuggggaccuaccacgaccugagaaagauauugaacaaauccuuccucgacaauaaagaaaacgcgcaaauaaucgaagacaucauacaaacccugacacucuucgaagaccgcgaaaugauucgccaaaggcuacagaaauacucagacaucuuuaccaaggcccaacucaagaaacucgaacgccggcauuacacaggauggggccgccucuccuacaaacuaaucaacgggauccgaaacaaagaaaacaagaaaaccauccucgacuaccucaucgacgacggguaugcaaaucgcaacuucaugcaacugaucaacgacgacgcauuauccuucaaagaagagaucgccaaagcccaaauuaucggcgacguagacgacaucgccaacguaguacaugaucucccaggaagccccgccaucaaaaaggguauauuacaaucugucaagauaguugacgaacugguaaaagucaugggacacaaccccgcuaacauaaucauagaaauggcacgagaaaaucaaacaacggaccgaggacgccggaacucccaacaacgccuuaaacugcuccaagacucccugaaaaaccuggacaacccuguaaacaucaaaaacguggaaaaccaacagcuacagaacgaccgccuauucuuauacuacauacaaaacggcaaggacauguauacgggagagacccucgacauaaacaaucugucacaauaugauaucgaccacauaaucccccaggccuauaucaaagacgacagcuucgacaaccgcguccugacaagcaguuccgaaaaccgaggaaagagcgacaacguccccuccaucgaaguagugugcgcgagaaaggcagacuggaugaggcugcgaaaagcggggcucaucucacaaaggaaauucgauaauuuaacaaaagcagaacgcgguggccuaaccgaaaacgauaaagccggcuucaucaaacggcaguugguagaaaccagacaaauaaccaagcacguagcccaaguccuagacgcccgauucaacgcuaaacaugacgagaacaaaaagguuaucagagacgucaaaaucaucacccucaaauccaaccucgucucccaguuccgcaaagacuucaaauucuacaaaguccgcgaaaucaacgacuaccaccacgcccacgacgccuaccugaacgccgucaucggaaccgcacuccucaaaaaguacccgaaacucgccucagaguucgucuacggggaguucaagaaauacgacguacgaaaguuuauagcaaaaucagauaaagaaauagguaaagccacugccaaauacuucuucuauucgaaccuuaugaacuucuucaagaaggaaguaaaauuugccgacgggacugucguagaaaggccagacauugaaaccucagaagacggagaaaucgccuggaacaagcagaccgacuucaaaaucgugcgcaaggugcuaagcuacccccaggugaauauagucaagaaaaccgaaguccaaacgcacgggcuagaccgcggaaaaccccgaggacucuucaacgccaauccaagcccaaagcccaaaccagacagcuccgagaaccucgucggagucaaacggaaucuggaccccaagaaauacgguggauacgcugggauaagcaacucauaugccgugcuuguaaaagcaaucaucgaaaaaggagucaaaaagaaagagaccaugguacuugaguuccaaggcaucucgaucuuagaccgcauaacauucgaaaaagacaagagggccuuccuuuuagguaaaggauacaaggacaucaagaaaaucaucgaacuacccaaauacucccucuucgaacuaaaagacgguucgcgccgcaugcuugccuccauccuuagcacuaacaacaaacggggagaaauacacaaaggaaacgaacucuucguaccccaaaaauuuacgacccuccuguaccacgccaaaagaaucaacaacccaauuaacaaggaccacaucgaauacguaaagaagcaccgagacgauuucaaagaacuccucaacuacguccuugaguucaacgaaaaauacgucggcgcgaccaaaaacggagaacgccuaaaagaggccgucgcagacuucgacuccaaaucuaacgaagagaucugcacguccuuccuaggcgcggugaacucgaagaacgcgggcuuauucgaacucacuucacucggaucugcuuccgauuucgaguuccucggugucaaaauaccccgauacagagacuacacccccagcagcuugcucaaggacucaacccugauccaucaauccauaacaggccucuacgaaacacgcaucgaucucuccaaacuaggagaagacuga

SEQ ID NO: 6708 - RNA, 4161 nt, Artificial Sequence
  Cas9 variant
augaccaaaaucacugaagacuacaucgugggccucgacaucggcaccaacucgugcggguggguagccauggauuccaaaaacacuauucuccgaaugcacgguaagaccgcaaucggaagccaccucuucgacgccggcaacagcgcugcagaccgacgagccuuucguacgacacgucggcgaaucaaacguagaaaauggcgacucaagcuacucgaggaaauauucgacucacaucuagcaaaagucgaccccuacuucuucgcacgccucaaagaguccgggcuaucaccccuagacacccgcaaaaacguaucaucaaucauuuaccccaccucccucgaagacaaaaaguucuacguggacaacccaacgauauaccaucucagauacaaacugaugaccgaagaccgaaaguucgaccuccgagaaguauaccuggcaauccaccacauaguaaaauaccgaggcaauuuucucuacaacacuccuguaaaggcguuugaagcauccaaaaucgacgucaaagguagccugaagaaacuaaacgaauuguaugagggacucgacagugaguucaacguugaacuggacuccaacaacgcccuggaaaucgaaaauauaauaagggacaagaagaucuuuaaaaucaacaaggucaaggaaaucaaccaacuccucagcuuaaaaaccgaggauaaggaacgaacaaagcuaaugaaagacgugagcaaacaaauugugaacgcuauccucggguacaagaccaaguucgagaccauccuacucaaagacgucagcaaggacgaggccgacgacugggaguucaagcucacagacguagacgcagacaauaaauucgaaaaccugaucggcgaccuaaacgaaaacgaacaagagauccuccuagucauccgaaagcucgcaaacgcaaucacacucucaaauauugucgaggaaggcaagacacuguccgaauccaugaaagacaaauacaagaaacacagcgaugaccugaaacuacucaagcaggucauaagcgaccacccagaccgagacaaggccaagaaacucgcccucgccuaugaccuguacgugaacaaccgccauggcaaaauccugcaagcuaaagacauacucgagaaaaagaaaacgcucucaaaagaagacuuuuacaaagaaaucaagaaaaaccuggacgacagcaaggaaucacaagaaauccuagacgcgaucucucuggacucguucaugccaaagcaacgcacgaacgaaaacggggucauaccauaccaguuacaccaacucgagcuagacaagaucaucgaaaaucagggaaaauacuacccauuccucaaggaagucaaccccgucucgucgcaucucaagcaagcaccauacaagcucgacgaacuuauacgauucagagucccauacuacgucgggccccucauauccccgaacgagagcaccaaaaacaaacaaaccaagaaaaaucaaaacuucgccuggaugauacgaaaggaacaaggacagaucacucccuggaacuucgaccaaaaaguggaucgaauggccagcgccaacaaauucaucaaacggaugaccacaauagacaccuaccuauuaggagaagacguacuccccgcgaacagccuucuauaucaaaaauucacggugcucaacgaacuaaacaacgucaaaauaaacgguaaaaggaucucggucccacucaaacaagagcuuuacaacaacuuauucaagaagaacucgacggucacgaccaacaagcucaaguccuauuuaaaggaaaacuacaaacuaaucaaagucgagauaaaaggccuaucggacgaaaagaaguucaacuccggccucaccacguacaacaagcugaagaaucuaaaaauauucgaccaacaaaucgacgauccaaacuacaacaaggacuuugaacgaaucaucgaguggucaacaauuuucgaggacaaagccauauacaaggagaaauuaaagacgaucgacuggcuguccgaccgccaaaucgacaaacuaagcaaaauacgaaugcagggguggggccaacucucaaagaaacuccugucccagcucacagauaacaacgggcaaacaauaaucgagcaacucugggacucccagaacaauuucaugcaaauaguaaaccaggcagacuucaaagacgcgauagcggucgcuaaccagaaccuucucgucgauaccuccguagaagacauacucaacgaagcauacaccuccccugcaaauaagaaagccauacggcaaguagugaaagucguagacgauauaguaaaggcgacaucaggaaaagucccaaaacaaaucgcaaucgaguucacgcgagacgccgacgacaacgccaagauaucccaaucccgcgcgaacaaacuacgcaaaguauacaaagaaauguccaacgagcuagcuuccgaaacaauacgcaacgagcuagaacggguagccaaggaccaaaaacuccuaaaagacaaacacuaccuuuauuucaugcaauuaggccgggacgcauacacaggcgaacugaucgacaucgacaaccucgaacaguacgacauagaccacgugcucccgcaauccuucaucaaagaugacucacuggagaaucguguccucgugaagaaagccgugaacaauggcaaauccgacaacguacccguaaaacuguacggcaacaggauggcaacagaccucggaaugacuauccggcacaugugggaaaaauggaaagaacaaggccucauaaccaaaaccaaauacaacaaccuaaucauagaccccgacaagaucaauaaauacgagagcagcggcuucauccacaggcaacuggucgaaaccucucaaaucauaaaacuggucagcaccauccugcaaucuaaauauccagacacggaaauaauaguaguaaaagcccgcuacaaccacuaccuacgcaaacgccugaaccucuacaagagccgggaagucaacgauuaccaccaugcaauugacgccuaccuaagcgcgaucugcggcaaccuccuguaucaaguuuaccccuaccugcggccauucuuugucuacggacaguacaagaaauucuccuccgagcccgaaaaagagaaaaucauauacgacaaaaccagacgcuacaacuuuaucucccagauauuugaaaacaaggauaacgacaucaucucucgcgaaacuaagaagaaagucuucgacaagaaagacauaaucgaaaaacucaaaagagccuacaauuauaaguacaugcuuguaucccgagaaaccgagacccacgaccaggaaauguucaaaaugacgguguaccccaggcuaagcagagauaccaagaaaucgcgcaaccucaucccaaagaagaaagacaugcccaccgaaauauacggcggguauaccaacaacagcgacgcauacaugauuauagcccggaucaacaaaaagaaaggccccgaauaccgggucuuuggcgucccaaugcgcgaacucgucaaucugcguaaagccgagaaaaacggccauuauaaagccuaccuuaaacaggugcucgaacccgagaucauguacagcaaaaacgguaagaaaaacaaaaccaucagcucauucgaaaucguaaaagccaaagucccauacaagcagguaauccucgauggcgacaaaaaguucaugcucgccuccagcacguacguacagaacgcaaaacaauuaacccugucacaauacuccaugcaggccaucaccgacaauugcgagaacgauacugaggaagaaaaagcccucgucgaggccuaugacgagauacuaaccaauaucgacaaauaccucccacuguucgacauuaacaaguuccgagagaaacuacaugcgggcagggaaaaguucguagaccucccccuagcugaaaagaaagaaacaauccuccaaguacugaacgggcuccacgauaacgcagugaugccuaaaaucaaaucacucggucugaguacuccccugggauucaugcaauuucauacagggguaagccuuucagagaacgcgaaauugaucuaccaaucccccacgggccucuucgaaaaacgacugaaaaucuccgaccuuuga

SEQ ID NO: 6709 - RNA, 4164 nt, Artificial Sequence
  Cas9 variant
augucagacucgaagaaauucgagggagaaaacguaaaaucaggcgacaagaagacgaacaaaaaccacggcaagguacucaaaagcucccccaaggaaauucggaaaaacaccgaguacuuuauaggccucgacaucggcaccucgagcgugggcugggcagucacuaacaccgauuaugagauccuaaaguuuaacggaaagcggauguggggaucccggcuauuuaaugaagcgucaacugccgaggaacgccgcgggcaucgagucaaucgacgccgaauacagaggcgucgcgacaggcugaaccuccucgaggaaaucuucuccgaagaaauggccaaaguggaccccgaguucuucaugcguuuaaaagaauccaaguuccaucucgaggacaaagacgaacguauacucggggaauccaacaucaucuuuaaaggaucagaggacggggauaagaaguacuacgaaaaauacccaaccaucuaccaccuaagacacaaacuuaugcaaagcugcgaagacguagacauucgcgaauuauacauggcccuccaccacauuauaaaguaccgagggcauuuccuauucaaaggagacuucgaggaaacaggcaccagcaucgaaaacaucauaaucgaacuucuagaacucaucaacaacaacuuaggcgucaaaaaguucgaauacaacgaaagccucaucaacgagcucaagaacaucgucagcaauacuuccaacaccaucaccaacaaaaagaagcugcuaggagaguucuucaacaagaaggaauacaaagcccacaagucacuauucauccuaucaauaggugcuagcguaaaacccgucgaccucuuccuagaagaagaguacaaggacauagaugacaucaaaaacauaaguuucaaaaaucuagaguacgaucaaguacgagacaccuacgaauccaucuuccuggacaaaaucgaguucaucgauguggcgaagcgucuguacgaugcgaccauacugcucaguaucaaacccgaaggaaagacccucagcgaagccaagguggacaucuacaacaaacaucacaaugaccuugagcuccucaaaaagguccuuaagaccgacaaagaaaaauacgauagcauccuaaaacucgacauaaagaaaggcaacaacuaugucaacuacgucaagaaaagcaaaaacggcaucagcugcagcaaagaagaguuucacaacgcccucaagaaaguucucgucaaaauagagaaaacggaugacauaaaauacauauugaacgaaauugaacuagagagguuccucccccuacaacgaguaaaagacaacucagucaucccguaccaaauacacagauaugaacucaagaagauccucgagaaugcgaguaagaaauucacauuccuaaaugaggagucagaugggcacacgaacaucgagaaaaucauaaaaaucauggaauaucggaucccauacuacgugggcccccucaacgaccaccacagcgucuacaacaauggauucgcgugggugucccgcaaacgguccggcagaauuacgccauggaacuuugacgaaaugguggacaaggaagagucggcugagcgcuucaucgaaaaccuaacgaacaaauguucauaccucaucggggaagaugugcuccccaaagaaucacuccuauauagcgaguucucgcuacuuaaugaacugaacaacaucaaauaugauggcaucucccuacccauagacauaaagaaaagcaucgucgaaaagaucuuccgcguggaaaagaaaagagucacuaaaaaguacaucaaagaguuccucaaacaggaaggauacagcgacggcaagggggaggucucggggaucgacaucgacauaaaaucggaccucaagucguaccgcgacaugguaaagaucuucggcacagagaucgauuaccguauggccgaaaauauaaucaaaugggucacacuguucggagacagcaaagaucuguuaaaaacgaagaucaacaaagaguacggagaaaaagucucaaaggaccaacugaagaaaguaugcaaacuuaaguauagagacuggggaagacucuccaagaaguuccuaacaggcauacguuccuccguacuggugaacgaugcaaccggcgaaggauacacaaucaucgaagccaugcgcaacaccgauaacaaccuuaugcaauugcugagaaacgaauacgacuaccucaaaaagaucgaccaaauaaauaugcuaucacggaaagacauugaugagauaagucacgacauacuagacgaccuauacuguucaccagccguaaaacgaagccucuggcaaacgauaaagaucguggaagaaaucaaaaagauaaugggccacgagcccaaaaagguauucgucgaaguaacccgaaccaacaaagccgacaagaaaacgacaauaacccgcaaaaacagacuucuggagcucuacagcgccaucaacgccgaaucaagagacugggucaacgaacucaacagcaccgaagucucuaaauucaacucgaagaaacuauaccuauauuacacacagaugggcaaaugcauguacaccggcaaaaacauagacaucgaaucccuauucacagacauguacgacaucgaccacaucuucccgcgaucaaaaaccaaggacaacagcuuugagaaccuaguccucgucacccgcaaagcgaaugccgacaaacgcgacgucuaccccauagaccccaaaauccaaaccgaacgaaaaagccuaugggacaugcuacacgacaagaaacuuauaggagacaagaaauacgacagacuaacgagaaccacggguuucacagacgacgaaaugagcggguuuaucgcccgccaacucguggaaaccagccaagcuaguaaagcggccgcggagauguuaaaacucauaaacaacgacuccgaaaucgucuacguaaaagccgagaaugugucugacuuuagacaugaaaacgaguucaucaaaguacgagaaauaaacgaccaccaccacgccaaggaugccuaccuaaacaucgucgucgguaacguguauaaugaaaaauucaccaaaaacccagccaacuauaucaagaaagguggaggaaacaacuacucgcugaacugcauauucaacaggaaccucgaccgaaacgguaaacgcaucugggacgaaaagaaaagcaucgacacuguaaaccgaaugaugaaaagcaaugacguaagagucacauucaaaaacaggguggacaaaggcccuaucuuaaacaaggucaccauacauaaggccucagaauuuauggacgacggcaaaaagaauaagaagggauuccccaucaaauccucagaaaagaacggaaacaaccgccuuugcaaccuguacaaauauggaggcuacaaggaccuaaacuauagccacuacaccaucgugcgauacaacgucuacgagaaaaagggcuuagauauuaaguacuauaugauccccaucccguacuaccugugccuuuguaacaucaaccaacacgacuacguauacgauuacauaagcaaccgcagcaagaaagaugucaacaacauugaaauaaucgucaacgaacugaaaauggggucccucaucaacaucgacgguuacaacuauuaccucggagggucaaagccaaagaccuucuacgucgacccggccuaucagaucauccuagacaaagaaaucgagcgcugcaucaaggagauagucaaagccaaaaacaacgaguaccgcuucaucaauaccgacaaaauaaauaaaaaccucaacaugaagaucuauaaauacaucguaaacaagaaaaucaucggggucuuccguaaccgcaaaugggacaaaggagaguaccucaacaguuccgaaacaaucgaaaaguucagugggcucagcgucgaaagccagugcaacgucauccuccgccuaaucaacgacaugcgaggcucaaacaagggaggcgccaacucgaaauucgacgagcuagaaaugacaauaucaagggccgaaaucccucaaaccuuaucaaacguuaguucguucaagauuaucaaucagaguauaaccggccuauucgagaacgaagugaccauaguauga

SEQ ID NO: 6710 - RNA, 4167 nt, Artificial Sequence
  Cas9 variant
augaccaaacccuacagcaucggccuugacaucgggacgaacuccguuggcugggcagucaucaccgaugacuauaaagugccgucgaaaaagaugaagguccuaggcaauaccucgaagaaauacauaaagaaaaaucugcuaggagcccugcuauucgacuccggcaucaccgccgagggccgccgacucaaacgaacagcacgacggcgcuacaccaggcgucgcaaccgcauacucuaccuacaagaaaucuucucaaccgaaauggcaacgcucgacgacgccuucuuucaacgacuagacgacuccuuccucguccccgacgacaagagggacucgaaguauccaauauucgggaaccuaguagaagaaaaggcauaccacgacgaguuccccaccaucuaccaccuacguaaauaccucgccgacagcaccaagaaagccgaccuacgucucgucuaucucgcucucgcccacaugauaaaauaccgcggucacuucuuaauagaaggagaguucaacagcaaaaacaacgacauacagaaaaauuuccaagacuuccucgacacauacaacgcaauauucgagagcgacuuaucacucgaaaauuccaaacaacucgaggaaauagucaaagauaaaauaagcaaauuagagaaaaaggaccgcauccugaaacucuucccaggggaaaagaacuccggcaucuucuccgaguuccucaaguuaauaguaggaaaccaagcagacuuuaagaaauacuucaacuuagacgagaaagcgucccuccacuucuccaaagaaucuuaugaugaagaccucgaaacacuacucggcuacaucggcgacgacuacuccgacguguuccucaaggccaagaaacucuacgacgccauacuccuguccggaauccuaacaguuacugacaacggcacagaagcaccccucucuagcgccaugaucaugcgcuacaaagaacacgaggaagauuuagggcuacucaaagccuacauccggaacaucagccuggagacguacaacgaaguuuucaaagacaauucaaagaacggauacgcagguuacauagacggcaaaaccaaccaagaagauuucuacguguaccuaaagaaccuccuaagcaacuucgaaggcgcggacuacuuccucgagaagaucgaccgagaagacuuccugcgaaagcaacgaacauucgacaacggcucuauccccuaccaaauccaccuacaagaaaugcgagcaauaaucgacaaacaggcuaaguucuacccguuccuggccaacaauaaagaaagaaucgaaaagauacuaaccuucaggauaccuuacuacgucggaccguuggcccggggaaacuccgacuucgcuuggagcauccgaaaacguaaugaaaagaucacucccuggaacuucgaagaugucauagacaaagaaagcagcgccgaggccuucaucaaccggaugaccagcuucgaucucuacuuaccggaagagaaggugcuaccaaagcacucccuacuuuacgaaacauucaacguuuacaacgagcugacaaaggucagauuuauugcagaaucgaugucuaaauaccaauuucucgacagcaagcagaagaaagacauaguccgacucuacuucaaagacaaacgcaaggucacggauaaagacauaaucgaauaccuccacgcaauagacggcuacgauggcaucgagcuuaaaggcaucgaaaagcaauucaacuccucgcugagcacauaccacgaccuacuuaacaucauuaacgacaaagaguuccuugaugacuccucaaacgaagcaauaauagaggaaauaauccacacccuuaccaucuucgaagaccgggagaugaucaaacagcgacugucgaaauucgaaaauaucuucgacaaaagcguacuaaagaaacucucgcgccgccauuacaccgggugggggaaacugucugcaaaacucauaaaugguauccgcgaugaaaaauccggcaacacaauucucgauuaccucauugaugacggcaucucgaaccggaacuucaugcagcugauccacgacgacgcgcucagcuucaaaaagaaaauacaaaaagcccagauaauaggagacgaagacaagggcaauaucaaagaggucgucaagucacucccgggcucccccgcgauaaagaaaggaauccuccagucaaucaagaucguagacgaacucgugaaaguuaugggcggcaggaagccugaauccauaguuguggaaauggcaagggagaaccaauacaccaaccaaggaaaaucgaacucucaacagcgucucaaaaggcuggaaaagucccucaaagagcucggcagcaagauccucaaagagaauaucccagccaaacucagcaagaucgacaacaaugccuuacaaaacgaucgccuauaccuauacuaccuucagaacgggaaagacauguacacaggugacgaucucgacaucgacagacucagcaauuacgacauagaccacauuauaccacaggccuuccuaaaagacaacagcauugacaacaaaguccuagugaguuccgccucaaaucgggguaaaagugacgacguuccaagucuagagguagucaagaaacggaaaacguuaugguaccaacuccugaaaagcaaacugaucucacaacguaaauucgacaaccuaaccaaggccgaacgcggcggccuuagcagggaagacaaagccucguucauccaacgccagcucgucgagacccgacaaauuaccaaacauguagcacgccuucuagacgagaaguucaacaacaagaaggacgagaacaaccgagccgugcgcacugugaaaaucaucacccucaaaagcacccucgucagccaauuccgcaaagacuucgagcuauacaaaguacgcgagaucaacgaccuacaucacgcgcacgacgcguaucuaaacgccgugguagcuucugcgcuacuuaagaaauaccccaaauuagaacccgaguucgucuacggugacuacccuaaauacaacagcuuccgcgaaagaaaauccgccaccgaaaagguauacuucuacuccaacauaaugaacauauucaagaaauccauaucgcucgcugacggcacaguaauagagaagccgcuuaucgaagucaaugaagaaacaggagaauccgucuggaacaaagaaucggaccucgccacgguaagaagaguccucagcuacccccaagucaacguaguaaagaaagucgaaaaacagaaccacgggcucgacagagguaaaccaaaaggccucuucaacgcaaaccuaagcucaaagccuaaacccaauagcaaugaaaaccuagucggagcgaaggaauaccucgacccgaaaaaguacggcggcuaugcaggaauaucgaacucauucgccguccuaguaaagggcacaaucgaaaagggagccaagaagaaaaucacaaacgucuuagaauuucagggaauaucgauccucgaccgcauuaacuaucguaaagacaaacucaacuucuugcucgaaaaaggguacaaagacaucgaacucaucauagaacucccaaaauacucccuuuucgagcucagcgacggcucacggcgaaugcuagccucaauccugagcacgaacaacaagcguggcgaaauacacaaaggaaaccaaauuuuccucucgcaaaaauucgugaaacuccuguaccacgcuaaacgcauaucaaauaccaucaaugaaaaccaccgcaaguacguagagaaccacaagaaagaguucgaggaacuguuuuacuacauccucgaguucaaugagaacuacgucggggcgaaaaagaacgguaaacuccucaacucagcauuccaaucuuggcaaaaccauucaaucgacgagcucuguagcuccuucauaggccccaccgguagugagcgaaaaggacuguucgagcugacaucacgggggucagcggcagauuucgaguuucuaggcgugaaaaucccacgcuacagagacuacacaccaucaucacuacucaaggacgcaacucugauacaccaaucgguuaccgggcucuacgaaacgcgaaucgaccucgccaaacuaggcgaaggcuga

SEQ ID NO: 6711 - RNA, 4167 nt, Artificial Sequence
  Cas9 variant
augacgaagcccuacucaauaggucuagacauuggaacaaauucugucggcugggccguaaucaccgacaacuacaaagucccguccaagaaaaugaagguccuugggaacaccucgaaaaaguacaucaagaaaaaccuacucggcguucuccucuucgauucagguaucacggccgaaggucgucgccuuaagcgaaccgcccgccgccguuacaccagacgccgcaaccggauacuauaucuacaagaaaucuucucaacagaaauggcuacgcuagacgacgcguucuuccaacgucuagacgacucuuucuugguaccggacgacaagcgcgacucuaaauaccccaucuucggcaaccuggucgaggagaaaguguaccacgaugaauuucccacuauauaccaccuccgcaaauaccuagccgacucgacaaagaaagcagaccuacgacucgucuaccucgcacuugcccacaugaucaaauaccgcggacacuuccugaucgagggugaguucaacagcaaaaacaacgacauccagaaaaauuuccaagacuucuuagauaccuauaacgccaucuucgagucagaccugucauuagaaaacagcaaacagcuggaagagaucguaaaggacaagauauccaaacuggaaaagaaggacaggauccuaaaacucuucccaggcgagaaaaacaguggcaucuucagcgaguuccuaaagcuaauuguggguaaccaagcugacuuccguaaaugcuucaaccucgacgaaaaagccucccuccacuucuccaaggaauccuacgaugaggaucuugagacccuacuaggguacauaggugacgacuacucagacgucuuccucaaagccaagaaacucuacgaugcaauccugcucucaggcuuccuaacagucacagacaacgaaaccgaagcgccucugucguccgccaugauuaaaagauacaacgagcacaaagaagaccuggcacuacucaaggaguacaucagaaacaucucucucaaaacguacaacgaaguuuucaaagacgauaccaaaaacggauacgccggcuacauugacggcaagaccaaccaggaagacuucuacgucuaccuuaagaaccuacucgccgaguucgaaggugcagacuauuuccucgagaaaauugaccgcgaagauuuccuucguaagcagcgcacauucgacaacggcucgauaccguaccaaauacaucugcaggaaaugcgcgcaauucuggacaaacaggcaaaauuuuacccauuccucgccaagaacaaagagcggaucgagaaaauuuugacuuuccguaucccguacuacgucggcccccuggcaaggggcaacucugacuucgccugguccauacgcaagagaaacgagaagauaacgccauggaacuuugaagacgucauugacaaagaaucguccgccgaagcguucauaaacagaaugaccagcuuugaccuguaccugcccgaggaaaaaguccucccaaaacacucccugcucuaugagacauucaacgucuacaacgaauugaccaaaguccgguucauugcagagucaaugcgugacuaccaauucuuagacagcaaacagaagaaggacaucguucgucuuuacuucaaggauaaaaggaaggucacugacaaagacauuaucgaauaccuccacgccauauacgguuacgacggcaucgaacucaagggaauagaaaagcaguucaacucaucccuaucgacguaucacgaccuacuuaacauaauuaacgacaaagaguuccucgacgacuccucuaacgaagccaucaucgaagaaaucauccacacccugacaauauucgaagacagagagaugaucaaacaacgacuauccaaguucgaaaauauauucgacaagucuguccucaagaaacucucgcgacgacacuacacuggcuggggaaaacuaucggccaagcucauaaacggaauccgagaugaaaagucgggcaacacaauccuugauuaccucaucgacgacgggaucaguaaccgcaacuuuaugcaacugauccacgacgacgcacuauccuuuaaaaagaaaauccaaaaagcgcagauaauaggcgacgaagacaaaggcaacaucaaggaaguggucaagucacuccccggcucuccagcaauaaagaagggcauucuacagucuaucaagauuguagacgaacuugucaaaguaaugggcgggaggaaacccgaaagcauugugguggaaauggcgcgagaaaaccaguacacgaaccaagggaaaucaaauucccaacaacgccucaaacgccucgaaaagucacucaaggaacuaggcagcaaaauccuaaaagagaacauccccgcaaaacucuccaaaaucgauaauaacgcacuucaaaacgaccgacucuauuuauacuaccugcaaaacgguaaagacauguacacaggagacgaucuagacauagaucgccuauccaauuaugauaucgaccacaucauaccccaagccuuccucaaggauaacucaaucgacaacaagguucuagucucuucugcaucaaaccgcggcaaaagcgacgauuuccccucccuggaaguaguuaagaaacgaaaaaccuucugguaucaacuacucaaauccaaacucaucucucaacguaaauuugacaaccuaacaaaagccgaacgcggagggcuccuaccugaagacaaagccggauucauacagcgacaacucgucgagacccgccaaaucaccaagcacguagcaagacuguuggacgaaaaauucaacaacaagaaagacgaaaacaaccgugcgguaagaaccguaaaaauuauaacccucaaaucgacccuggucucccaguuccgcaaagacuucgagcuauacaaaguccgcgaaauaaaugauuuccaccacgcccacgacgcuuaccucaacgccgucaucgcgagcgcacuguuaaagaaauacccaaaacuagagccagaguucguguacggagacuaucccaaauacaacagcuuccgagaaagaaaaucagccaccgaaaaaguguauuucuacuccaacaucaugaacaucuucaagaaauccaucucacuggccgauggacgcgucaucgaacgcccccuaauagaaguaaacgaagaaacgggagaaucggucuggaauaaggaaagugaccuagcaacgguacgacggguccucuccuacccacaagucaacguagucaaaaagguagaagaacagaaccacggacucgaucgaggaaaacccaaaggacuguucaacgccaaccuaucaagcaagcccaaaccaaauuccaaugaaaaucuagugggcgcaaaagaguaccuagacccgaagaaauacggcggcuacgccgggauauccaacucauucgcaguccuaguaaaaggcaccaucgagaaaggagcgaagaagaagauaaccaacguccuagaauuucaaggcaucucgauucuugaccgcaucaacuaccgaaaggacaagcucaacuucuuacuggagaaagguuauaaagacauagagcucaucauagaacuccccaaauacagccuguucgaacucagcgacggaagucggcggauguuggcgucgauccuaucaaccaacaacaagcgcggagagauccacaaaggcaaccaaauauuucugucccagaaauucguaaaacuucuauaccacgcgaaacgcauuucgaacaccaucaacgaaaaccaccguaaauacgucgaaaaccacaagaaagaguucgaagaacuauuuuacuacauccuagaguucaacgaaaacuacgucggcgcuaagaaaaacggcaaacuacucaauucagcauuccaaucauggcaaaaccacagcaucgacgagcuguguagcucauucaucggaccaaccggcucagaacggaaaggacuguuugaacugacaagccggggcagcgccgcagacuucgaguuccucggcguaaaaaucccccgguaccgcgauuauacccccucaagccuucucaaagaugccacgcuaauccaccagucaguaacaggccuauacgaaacccgcaucgaucucgcaaagcugggagaaggauga

SEQ ID NO: 6712 - RNA, 4167 nt, Artificial Sequence
  Cas9 variant
augaccaaaccauauuccaucggccuggacaucggcacaaauagcgucggcugggccgucaucacagacaacuauaagguccccagcaagaaaaugaaaguccuagguaacacgucgaaaaaguacaucaaaaagaaccucuuagguguacuccucuucgacucaggcaucacggccgaggggcgcagacucaaacgaaccgcucggcggcgauacacacgaaggcgcaaucgcauacuauaucuucaggaaauuuucagcacagagauggccacgcucgacgacgccuucuuccagcggcuagacgacagcuuccucguccccgacgacaagcgagacagcaaauacccgauuuucggcaaucuagucgaggaaaaggccuaccaugacgaauucccaaccaucuaccaccucagaaaguaucuagcagacucaaccaaaaaagccgaccuucgcuuggucuaccuagcccucgcccacaugaucaaauaccgggggcacuuccuuauagagggcgaauucaauucaaaaaacaacgacauacagaaaaacuuucaagauuuccuagacaccuacaaugccauauucgaauccgaccuaucccucgagaacucaaagcagcucgaagagaucguaaaggacaaaaucucaaagcuagaaaaaaaagacagaauacuaaaacuuuuucccggagaaaagaacagcggaaucuucuccgaguuccuaaagcugaucguagguaaccaagccgacuucagaaagugcuucaaucuagacgaaaaagcgucacuacacuucucuaaagagagcuacgacgaggaccuagaaacucuacuuggcuacaucggagacgacuacuccgacguauuuaucaaggcgaaaaagcucuacgacgcuauccuccuuuccggauucuuaacagugacagacaacgaaacagaagccccgcucuccuccgccaugaucaaacguuacaacgaacacaaagaagaucuggcgcuccuaaaagaguacauacgaaauaucucacugaagaccuacaacgaaguguucaaagacgacacaaaaaauggguacgccggguacauagacggaaagaccaaccaagaagacuucuauguuuacuugaagaaccuccucgcggaauucgagggagcagacuacuuucuggagaaaauagaccgagaggacuuucuacgcaaacagcgaacguuugacaacgguagcauacccuaccaaauccaccugcaagaaaugcgcgccauccuggacaaacaagccaaguucuaccccuuccuugcuaagaacaaggaaaggauagaaaagauccuaacguuccggauccccuacuaugucggcccacuagcccgcggcaauagcgauuucgcguggagcauccggaaacgcaacgaaaaaaucacacccuggaacuuugaggaugucauagacaaagagagcagugccgaggccuucaucaauaggaugacaagcuuugaccucuaccugcccgaggaaaaggugcuccccaagcacucacuacucuacgaaaccuucaacgucuacaacgagcuaaccaagguccgauucaucgccgaaagcaugagagacuaccaauuccucgacucgaagcaaaagaaagacaucguacgucuauacuucaaagacaaacggaaaguaaccgacaaagacaucaucgaauaucugcacgcgauauacggauacgacggaaucgaacucaaaggaauagaaaaacaauuuaacuccagccuguccaccuaccacgaccuacucaacaucaucaacgacaaggaauuucucgaugacuccucuaacgaagcaaucauagaagagaucauccacacucuaacaauauucgaagacagagaaaugauaaaacaacggcucucaaaauucgaaaacauuuucgacaaauccguacucaaaaagcuuagccgccgacacuacacgggauggggcaagcuuuccgccaaacucauaaacggaauccgagacgagaagagcgguaacacgauccuggauuaccuaaucgaugacgggauaagcaaccgaaacuucaugcaacucauacacgacgaugcccuuucauucaaaaaaaaaauucaaaaagcccagauaaucggagaugaagacaagggcaacaucaaggagguggucaaauccuuacccgggucaccagcuaucaaaaagggaaucuugcaaagcauaaaaaucguagacgagcuggugaaggugauggggggccgcaaaccagaguccauaguagucgagauggccagagaaaaucaauacaccaaccaaggcaaaucaaacucccaacaacgacucaaaagacucgagaaaagccugaaagaacuuggcagcaaaauccuuaaagaaaacaucccagcaaaacucuccaaaaucgauaauaacgcucuccagaacgaccgcuuauaccucuacuaucuccaaaacggaaaggacauguacacuggcgacgaccuugauaucgaccgccugucaaauuacgacauagaccauaucaucccccaagccuucuuaaaagacaauucgauagacaauaaggucuuagucucaagugcgagcaacagaggcaaaagcgacgacuuccccagccuugaggucgucaaaaaacggaagaccuucugguaccaauuacucaaaucgaagcuaaucucgcaacgaaaguucgauaaccucaccaaagcagaacgcggcggccuacugcccgaagacaaagccggauuuauccaacgccagcuaguugaaacccgccagauaacaaaacauguggcccgccuacuggacgagaaguuuaacaacaaaaaagacgagaacaauagagcgguacgcacagucaaaaucauaacccuaaaaucaacacuggucucccaauuccggaaagacuucgaacucuauaaaguacgcgaaaucaacgacuuccaucacgcccacgacgccuaccugaacgccguaauagccuccgcccuccuuaaaaaguacccgaaacucgaacccgaguucguauacggcgacuacccgaaauacaacucuuuccgcgaaaggaagucugccacggagaaaguauacuucuacagcaacaucaugaauauuuucaaaaaaagcauaagccucgcggacggacgcgucaucgaaagaccccucauagaagucaaugaagaaacuggggaaagcguguggaacaaggaaucagaccuagccaccguacgacgcguacuauccuacccccaagucaacguggucaaaaaaguagaagagcaaaaccacggguuagaccggggcaaaccgaaaggccuguucaacgcgaaccucucaagcaaaccaaagcccaacagcaaugaaaaccuaguuggggccaaagaauaccuggacccaaagaaauacggcggauacgcggggaucuccaacaguuucgcaguccucgucaaaggcaccauagaaaagggggccaagaaaaaaauaacgaacguauuagaguuccaaggaauuagcaucuuggauaggauaaacuaccggaaagacaagcuuaacuuccuccuagaaaaaggcuauaaggacauagaacuaauuauagaacucccaaaauacucccuauuugagcuaucggacggcucacgccgaaugcucgccucaauccuaagcaccaacaacaaacgaggcgagauccacaaaggcaaccaaaucuuucuuagccaaaaauucgucaagcuccuauaccacgcgaagcgcauaucaaacaccauuaacgagaaccaccgcaaauacgucgagaaucacaaaaaagaauucgaggaauuauucuacuacauccucgaauucaacgaaaacuacguaggcgccaaaaaaaacgguaaacugcucaacuccgccuuccaaucguggcaaaaucacagcaucgaugagcugugcucaagcuucaucggccccacagggagcgagcgaaaaggccucuucgaacugaccucccgaggaagcgccgccgacuucgaauuccucgggguaaagauccaacgcuaccgcgacuacaccccaucaagucugcugaaggacgcgacccucauacaccagucaguaacgggacucuacgagacccgcaucgaccuagccaaacuaggagagggcuga

SEQ ID NO: 6713 - RNA, 4167 nt, Artificial Sequence
  Cas9 variant
augaagcgcauccuuggccuagacuugggaacaaacuccaucggcugggcccuggucaacgaagcagagaacgaaaaggaaaucucuaagauuaucaaguuaggugugcgagucaacccgcugacaauagacgagaaaaccaacuucgaaaagggccgcccccuaagcacgaaugccgaccgaacacucaaacgcggcgccagacgcaaccuacagcgauacaaacucagacgagagaaccuaaucgagauccucaucgacaaccacauaaucacaaaagaaacgccacucaccgagauaggcaaggguaccaccuaccagacgcuaucucuucgcgccaaagcaguccgcgagcgaauagaucuagaagacuuugccaaaguucuccucgcaaucaauaagaaacgcggcuacaaaagcagccggaaagccagcaaugacgaggagggucaagcaaucgacggaauggcaaucgccaaagagcuuuacgaaagagguaucacccccggccaguacgucuuggagcugcuugaaaacgaccgaaaauacauccccgacuucuaccgaucugaccucaaacaggaauuuaacaaaauauggaacaaccagaaaacauucuacccagaaauccuuaccgacgaacucuucaaggaacucgacggcaagaauaaaagucaaacgugggcgauaugccagaagccauucaacauaaaaggcaucaaacguauaaccaaaggaagggaaaagaccauagaaaacuaccacuggagagucaaagguuuaagcggaaaacuaaaccuggagaaacucgccauaauccugcaagaaauuaacaacgacauaaaccaauccagcggcuaccucggcgggauuucagacaaaucaaagaaacuuuaccucaacaaagaaaccguaggggaguucuuauacaaacaaaucgccaagaauccucauacaagccucaaaaaccaagucuucuaccgucacgacuaccuagacgaguucgaacaaaucuggaagacacaauccaacuucaacgccaaucugacagacgagcugaagcaggaaauccgcgacguaaucaucuucuaccagcggaagauaaaaucucagaaaucacucauuuccuucugccaguucgaaagcugggagcaagaguauuucgacaaggaaaccggcaaaaccaagacccggaccguaggaagacgcgucauccccaagagcagcccucuauuccaagaguucaagaucuggcaaaaccugaaucaccucguuuucacaaauucagaaacggacgagaaaaucgaaaucaaagaagucgagcaagaaauacggaaagaacuuuucgaggaacugaaccuccgaggagaccucaacccaaacgaccuccugaagauucuccgcagucaguucaaaauugggaagcuaucgaauuggaaaugcaacuucgaaaagaucgaaggcaaucgaaccaaugccgcccuguucaacauauaccagaaaaucagcgacuucgaagguuacggaauagacuggaacaaaagcaaugccaagaaaauccgaaaagaacuaaaggcaaccuuccccgagaucgggaucgacgccucgauccucgaguucgacgcguacaagaaacaauugacaaaccaaagcagcuacgaacuuuggcaucugcucuacucagcagaagaagacuuuaaaauauccgaacaagacaaacuaaucuacgguaacucauccguuagccugaaaaagaagcuacacuuaaaauucggguucaaccccgaauacgcgaaaaugcuagccaaucuaucucucauguccgacuacgggaaccugucggcgaaggcaaucaagaaaaucuuaccauaccuagaagacggccaccuguacuccgaagccugccgccuagcgggauacaaccacucaaaaagucucaccgccgaagaacucgaaaaauucgagcccaaagccaaacuagaccuccucaagaaaaacagucucagaaacccgguaguagagaaaauccucaaccaaauggucaaugugguaaaccaaguaaucgacaccuacggcaaaccagacggagucagaaucgaacucgcccgcgaacucaaaaaguccgcgaaagaacgagcagagaugacgaagggcauagcggacggcacgcgacgcaacgaagaaauaaagaaaaucaucacacagaaauucggcaucccgaacccgaccaaaucagaccucguacgauaucgccucuggcaagaacuagaaagccgcggcuacaaagauauauucacagacaaguacaucagccccgacaagaucuucagcagcgaaauagacaucgaacacauaauccccaaggcccucuuauucgacgacuccuucuccaacaaaacacucucauuccgcaacgucaaccuuaaaaaggccaaccgaacggcccucgacuucaucacgcaggacuaccaguccaacgucgaagcguacaaggagcgagucgaaacuuggaacaaggacaaucacauuucaaaggggaaacggaauaaacuccucaugagccucaaagacauccccgacggguucaucgaaagggaucucagaaacucucaauauaucgcgcgaaaagcuaagagaaugcuuuaugaagucuucccaaacgaaguccuagcaacauccgggucgaucacugacaagcuccgcagcgacugggaccuuaucaacgucaugaaagagcucaaccucccaaaauacaaagcccucggccuaaccgaguaugaagaacgucuggacaaaggcacugaagaacucuucaagcacgaagugauuaaggauuggaccaagcgcaacgaccacaggcaccacgcgauggacgcccuggccgucgccuucaccacacacaaccacauccaauauaucaauaaucucaacgcgcgcaaagacauaacucaagacaaccaccccauaaucaaaaauaucgagaaccuaauaacugaaguaaacucaaaaggcaagcgaguguucaaagcaccuaugagcucauucagggaaucggcgaaagagcagauagaagcaauacuugucucguucaagaacaaaaacaaagucgugaccaaaaacauaaaccaaaccaagaaagagggcggauucaacuaccaaaacgcgaaaacacccagaggacagcugcacaaagaaaccaucuauggcaaaagcaaacaaccucuagaaaaacccgugaaaauaaacaaccgcuucugcaaaaagcaagucggucuaauuaucaauuuuaaagagcaagaagccguccuacaccaccucaagaaauacgacaacaacgagaaaauagccuucucaaacaaaacucuuaaaucugaccccauccaaguuaauggcucaccccuccgcgaaguaaaaaucuucgaagaaaucuuuaccauccgaaaagauauuaaccccgacaacuucaagacgcaaaagcaccuugacaagaucaucgacaagggcaucaaagaaguaaugaagaaacggcuagaggaguacaacggcgauuucaaaacggcuuucuccgaccuagacaaaaacccgaucuggcucaaccaguccaaaggcauaacgaucaaacgcgcgacaauaucgggggugacgaacgcagaaccacuccaccaagccaaggaucaccuggggaacauaauacuagacgacaaugggaaagagauacccaucgacuacgucagcacgggcaacaaccaucauguagcuauauaccaggacgaauccgguaaucuucaagaagaaguagucucguuuuaugaggccguaauccgcaaaaaccaagaccaacccauaauaaagaaacgccaccccaaagguuggaaauuccucuucaccaugaaacaaaacgagauguucgucuucucauccgaaaacuucaacccgagcgagaucgaucuccuggacgagaaaaacgcagcuaucauuucaccgaaccucuuucgcgugcagaaaaucgcaacgaaaaacuacauguuccgacaccaccuggaaaccgaggucaccaacaaccucgacuucaccuaccgccacuuccaagcgaccgaguggcuccgaaaccugugcaaaguacgcaucgaccacauaggacgaauagugcaaaucggagaauauuga

SEQ ID NO: 6714 - RNA, 4170 nt, Artificial Sequence
  Cas9 variant
augauaauacgaacguaugaguuaaaaacaaucacuacuauagcuauucuaaagauguuccaacuacuaaccggagggcucagcaugaccaagcucgggaaaccguacgggauaggggucgacaucggcucaaauagcauaggcuucgcggcugucgacgaaaauucacaccuaaucagacuuaagggaaaaaccgucaucggugcccgccucuucgaagaagggaaggcagccgccgaccggcgagcaagccgaacgacucgacggcgccucagcagaaaccgauggcgccuguccuuccuccgcgacuuuuucgagucacacauaacccccacggggcccaacuucuucaugcgccaaaaauacagcgaaaucuccccaaaggauaaagccagauacaaguaugagaagagacucuucaacgaucgcaccgacgccgaguucuaccaacaauauccaaccauguaucaccuucgcaacaggcuauugaccgauccgagcaaagcugacguacgugagaucuauuucgccauucaccacauucuaaagucgcgcggccacuuccuaaccagcggcuacgcuaaagacuucaacaccaauaaaguagcccucaaugaaaucuucccggcccuacaagacgcauacgcccaaguguacccagaccucgacaucacguucgacgagaacaaaguaaacgaguucaaaaccgugcuacuaaacgaaaaggcgacgccaucagacacucaacgagcccucgucaacuugcuacucgccgaagacggcgacaaagacaucuuaaaacagcagaaacaggugcucaccgaguucgccaaagcagucguagggcuaaagacaaagcucaacguagcacuaggaacagaaguugacagcuccgaagcuacaguauggaacuuuucacuaggccaacuagaugacaaaugggccggcaucgaauccgccaugacagacgaaggcaccgaaauucuagaccaaauccgcgaccuauaccgggcccggcuacucaacgguauaguaccagcgggcaaaacgcucucgcaagccaaaguagacgacuacgcgcagcaccacgaagaccuggagcucuuuaaagacuaccuuaagcaacuagaagaugacggaaccgccaaagcaauccgacaacuguacgaccgcuacaucgacggugacgaugcgaaacccuuugugagagaagacuuugucaaagcccucacaaaagaagucaccgcccaucccaaugccaagagccccgaacuacuugagcgccuagcgcaaccagacuucaugcuaaagcaacguaacaaagcaaacggcgccaucccaguccaaaugcaacagcgcgaacuagaccaaauuaucaaaaaucaaagcgucuauuacgacugguuagcugccccaaaccccguagaaaaacaccgcaaauccaugcccuaccaacucgacgagcucuuaaacuuccgcauaccauacuaugucggcccucugguuaccgcaaaagaacaaaaagccgcacaaggagggguuuucgcauggauggugagaaaagacccagacggaaacauaacccccuacaauuucgaugaaaagguugaucgugaagcaagugcgaacacauucauccaacggaugaaaaccaccgacaccuacuuaaucggcgaagacguguuacccaaacaaagccuacucuaccagcgauacgaaguacucaaugaacuaaacaacgugagaguaaacaaugaaaaacuaucuaucgaacaaaaacagcaggucauacgcgagcuguuugaaagacacaacagcgugacaaucaagcaauucgccgaaaaccuacgggcgcacggggacuacgcacacaucccggagauacgaggccucgccgacgagaagcgcuuucucuccagccucagcacauaccgucaacuaaaaucgcugcuccccgacgcaauagacgaccccgccaaacaagcagacaucgaaaacaucauagccuggucaacagucuucgaagacgccgccaucuucaaaacgaaacuaaaggaaauaaacuggcucgauagucaaacgauaaccaagcucagcaacaucagauaucgcggauggggccaauucucgcauaaauuccuaaacggacuuacacucggcaacggacauaccaucauccaagaacuauuccucagcaacaacaauuugaugcaaauacugaccgacgaaacccuccaaaagaaaaugacagagcuaaacgcagacaaacucaaagccgcaaacaucaacgacgcgaucgacgacgcauacacaagccccaguaacaagaaagcacuccgccaaguucuccggguaaucgaagacaucaaacgcgccgcagacggacaggauccaagcuggcuauacguugaaaccgccgacgggggcggaacgccgggcaaacgcacacgagcaaggcagcaccaauuacaagaaaucuacgccaacgccgcgcacgagcuuaucgacuccgccguccggggagaacucgaagacaaaaucgccgacaaagcagacuucaacgaccgccuagugcuauacuucaugcaaggagggcgggacaucuacaccggaaccccacuaaauaucgaccagcuauccuccuacgacauagaccacauccuaccacaaagccuuauuaaagacaacucccucgauaaccgcguacugguccacgccauuauaaacagagagaaaaacgccaccuucgcuucaacaauauacgcccagaaaaugaacgccaccuggcgucaauggcacgaagcuggccuaauaucaggacgcaaacuccgcaaccuccaaaugcggcccgaccaaauagacaaauacgcaaguggcuucgucgcccgucaacugguugaaaccaggcaaauuauaaaacugaccgaacaaaucguggcagcccaauacccagaaacuaaaaucauugccgucaaagcagggcuaucgcaucaauuaagagaggaacucgaguuccccaagaaccgggacguaaaccacuaucaccaugcauucgaugccuuccuggccgcccgcaucggaaccuaccuccucaagcgauucccaaaccugcaggcauucuucacauacggaaaauucaagaaagccgacgugaagaaacugcgcggcuuuaacuuuauacgagacauaacacaugccgaagacaaaauagucgucaaagacaccggagaaguaauaugggauaagaaaagagacguagacgaacuugaccggauauacaacuuuaaacggaugcuaaucacucacgaaguacacuucgaaaaagccgaccuauucaaacagaccgucuacggggccaaagacuccaaagaagcaggcgggaagaaacagcuaaucuccaaaaagaaaggguacccagucgacauauaugggggcuauacccaggaaaccgggucauaccuaucggucguacgacucaccaagaaagcuauguacgcagugguaaaagucucuaccagggacgcagcaaaacuagccguagccaaauccaucuccgaacagaaagaaaacgaaacacucaacgacaucauagacgaaaaacucuccaaaauaagcaaaaauggcaaaauaacucacgaacuguucgaggucguccuaccacgaguuggccagaaaacucuauucaaaaacucaaaauacaaccuuuuccugguaaacagugacaccuauaugcacaacuaucaggaacucuggaugccccgggaauaccagaaaauguggaaagacaucagccucucaaaguacggcgaugcccaaacagaggaucaacuggaccaaaucuucggguucaucguaucucaaguuaauagcuacuucaaccucuacgauaucaaccaauuccggaaaaagcucaacgacgcugcggauaaauucgcaacccucccaaugcgcgacacagacgacaugcaggggaaaauagcuacaaucggccagcuccuaauaggccuucaggcgaacgcggcucgaucggaccuaaggaaccuggacauaaaaacgccacuagggcuccuacaaaucccgaacgggaucagucuggacagcgacacuuccgucgucuaccaaagcccaaccggacuauuagaacgcgagguccaccuuucugaccuauga

SEQ ID NO: 6715 - RNA, 4170 nt, Artificial Sequence
  Cas9 variant
auggcccgggacuacagcguaggccuugauaucggcaccagcucaguaggcugggcagcgaucgauaacaaauaucacuuaauccgggcaaaguccaagaaccucauagggguccggcuguucgacagcgcggucaccgcggagaaaaggcgcggguaucgcaccacacgaagacggcucagccgacgacacuggagacuacgccuccuaaacgacaucuucgccggcccucucaccgacuucggagacgaaaauuuucuggcccggcucaaauacagcuggguacacccccaggaccagucaaaccaagcacacuucgccgcaggccuacucuucgacagcaaagagcaggacaaggacuucuaucgaaaauacccgaccauauaccaccuacgccuagcgcucaugaacgacgaccaaaaacacgaccucagagaaguauaucuugccauccaucaccuaguaaaauaucgcggacacuuccucauagaaggcgacgugaaagccgacucagcauuugacguccacacauucgccgacgccauccaacgauacgcagaaucaaacaacagcgacgaaaaccuauugggaaaaauagacgaaaagaaacuuuccgcagcuuuaacagacaaacauggcucuaaaucacaacgugccgaaaccgcagaaacagcauucgacauccuagaccuacaauccaagaaacaaauccaagccauacucaaauccguuguaggcaaccaagccaaucugauggccauuuucggccucgauucuuccgcaauaucaaaagacgaacagaaaaacuauaaauucaguuucgacgacgccgacaucgacgagaaaaucgcggacagugaagcccuacuuuccgacaccgaguucgaauuucucugcgaccugaaagcagcuuucgacggccucacacuaaaaaugcuccuaggcgacgacaaaacugucucagcagccaugguccgccgauucaacgaacaccaaaaagacugggaauacauaaaaagccacauccgcaacgcuaaaaacgccgguaacggccuguacgagaaaagcaaaaaguuugacggcauuaacgccgcauaucuugcgcugcaauccgacaacgaagacgaccgcaaaaaggccaaaaagauauuucaggacgaaauaagcuccgcagacauaccagacgacgucaaagcggacuucuugaaaaagauagacgacgaccaguuucugccaauacagcggaccaaaaauaacggaacuaucccccaccaacuccaccgaaacgaacucgaacaaauaaucgagaaacaaggcaucuauuacccauuccuaaaggacaccuaccaagaaaauucccacgagcuaaacaagaucacggcccucauaaacuuccgagucccguacuacgucggcccuuuagucgaagaagaacagaaaaucgcugacgacggcaagaauauuccagacccuacaaaccacuggaugguccgaaaaagcaacgacaccauuacccccuggaaccucucacaaguggucgaucuagacaaaagcggccggcgguucaucgaacgccugacaggcaccgacaccuaccucauuggcgaacccacccuacccaaaaacucuuuacucuaccagaaauucgacguauugcaagaauugaacaacauaagaguaagcgggcgccgacuagacauucgcgccaaacaggacgcuuucgaacaucucuucaaaguacagaaaacugucucggccacaaaccucaaagacuuccucgugcaagcaggauacauaucagaagacacccaaauugagggucuagcagacgucaauggcaagaacuucaacaacgcccucacaacauacaacuaccuaguuucgguacucggcagagaguucguagagaacccguccaacgaggagcuccucgaggagauuacagaacuacaaaccgucuuugaagacaagaaaguacuccgacgccaacuagaucaacucgauggccuaagcgaccacaacagagaaaaacuuucccggaaacacuacaccggguggggacgaauaucaaagaaacugcuuaccacaaaaaucguacaaaaugcagacaaaaucgacaaccagaccuucgacguaccacgaaugaaccagaguauaauugacacucuguacaauacaaaaaugaaccugauggaaauaaucaacaacgcugaagacgacuucggcgucagagccuggaucgacaaacagaauacgaccgauggagacgaacaagacguauacucgcugaucgaugaacucgcagggcccaaagagauuaaacggggcauuguccaguccuucagaauccucgacgacaucacaaaagcgguaggauacgcaccaaaaagaguuuaucuagaauuugcccgcaaaacgcaagaaagccaccuuacgaacucgcggaaaaaucaacuaucgacccuccucaagaaugcuggucugucugagcuaguaacacagguaagccaguaugacgcagcugcccuccaaaaugaccgcuuauaccucuacuuccuccaacagggaaaggacauguacuccggagaaaagcucaaccucgacaaccucucgaacuacgacauagaucauaucauaccucaagcauauacuaaggacaauucgcucgacaaccggguacucguuucgaacaucaccaaccgcaggaaaucagauuccuccaacuaccucccggcacugauagacaaaaugcguccauucuggucagugcugucgaaacaaggccucuugucgaaacacaaauucgccaaccucacgcgaaccagggacuucgacgacauggaaaaagaacgauucaucgcucgaucgcuaguggaaacccgucaaaucaucaaaaacgucgccucacucauagacucacacuuuggcggagaaaccaaagcggucgcaauaagauccuccuuaacagccgacaugcggcgguacgucgacauaccgaaaaaccgcgacauaaaugacuaccaccacgccuucgacgcacuccuguucucaacuguaggucaguauacggaaaacucuggccucaugaaaaagggccagcuuuccgauagcgcaggcaaccaauacaacagauacaucaaggaauggauccacgcagccaggcucaacgcgcagucccagcgagucaaccccuucggcuucgucgucggcucaaugcgcaacgccgcccccggcaagcuaaauccagagaccggagagauaacgcccgaggagaacgccgauuggucaauagcagaucucgacuaucuucauaagguaaugaacuuccgcaaaaucaccguaacacgccgacuaaaagaccaaaaaggacaacuauacgacgaaucacgcuaccccucuguucuccacgacgccaaguccaaagcaagcaucaauuucgacaaacacaaaccgguagaccuauacggcggauucaguucagcuaaaccagcguacgccgcuuuaaucaaauucaaaaauaaauuccgucuggucaauguccuccgacaauggacauacucggacaaaaauuccgaggacuacauccucgagcagauuaggggaaaauaccccaaagcggaaauggucuuaagccacauacccuaugggcaacucguaaagaaagacggcgcccugguaaccaucagcuccgcgacagaacuacacaacuuugaacaacuauggcugccgcuagccgacuacaaacucauuaacaccuuacugaagacgaaggaagacaaccuaguugacauccuccacaaccgccuugaccucccugaaaugacaaucgaguccgcauucuacaaggccuucgacagcauccuuuccuucgcuuucaaccgcuacgcccuccaccaaaaugcacuggucaaacuccaagcccaccgagaugauuucaacgcucucaacuacgaagacaaacaacagacccuugagcggauccuagacgcccuccacgcaucgccggccuccagcgaccucaaaaagauuaaccuaucuagcggauucggccgucucuucucucccagccauuucacacuugcagacacagacgaguucauauuccaaucaguaacaggccuguucucaacgcaaaagaccgucgcucagcuuuaccaagaaaccaaauga

SEQ ID NO: 6716 - RNA, 4170 nt, Artificial Sequence
  Cas9 variant
augaaaaacuacaacaucucauuaguccccagucccuccggggucggguacgccgucaccgacgacaaccuuaacauaauaaagcccgugcaccaugucucuggcaucggaucccggcuguuuaacgaaggcuccucgaaacaagaccggcguaacucgcgaagcgcacgccgcucccgacaccgccagcaagggcgcaucaaagcgcugaacuccauuaugaaagaugaaaucauaaaggucgaccccacguucuucgaccggcuguaccaauccgaacucagcccccucgacaagaacaaaaaguaccggaacauaauuuucgacaaacccucagucgaaagcuacuauuacaagaaauuucccaccauauaucaucuggaaaaauaccucaucaauacagacggcaaagcagacauacgccucauuuacugggcccugcacuccuuacuaacccaccggggccacuucuacaacacuaccccggucucccaguucaaacccggcgcccuaaacauaaaagacaaauucauagaacucaaccaacucaaccaaguaaaaacauucgaguucucaguggccaacacaccagaaaucgaacacauucucaaagauagauacauaagcaaacaaaauaagauuaaccaacucgcggaacuccucuuugaacaagaaccggaaaaagacauacaaaaggccaauaccaagguagcaaagacgauagcgaaggccauucugggcaacaaauuucaacuagacgaaauaauuggacucgaugucaacaaauccgaaaagaaagaauggucucuccaacuauccgaucucaaccucgacuccaaaaucgacgaacuaagcgacuccuuaaccgaccaacaacuccggaucuuggagauacuacaagaaauguacgccgcaacgacccuacucgacauuuugcaagggucggacucauugcuagaugcaaaaaucaaaucauacaacgaauacaaacaaaaccgccucuuguucuucgaccuucugaaaacccuccccgacaaaaaggcccaucugcugcgccagggcuacacccuuuaccucaacaaccaccaccgcgaccucgcaucugcccgcaaggaccugggaauaguggcggccacaaauuuuagcaaaacagaccucuacgcccugaucaaaaagacccucaaggacgagcccgaaaccccagaauccaagaaaguacuuggccucauagacaaaggcgaguuccuaaauaaacaacggacagaccucaacaccuacauccccuaccaacucaacgcacugauccuaaacaaaauacucaaaaaccaggggaaacacuacccguuccuaaucaaagaaaacccagccgaacccgaccgcaaagaagcaccguacgaaaucagccaauugaugcaauucaccaucccauacuacuguggaccacucgcaacgccagaggaacagaaaaaccuaccagaguccucuagauucggauggcucguccgcaaagaggaaggacguauaaccccuuggaacuuuuacaacaaaauaaacgucaucgagaccgcaaacgccuucaucaaacgaagcaucgguaaagacaccuaccuucuuagcgaacccgugcucccugacaacagccuacuauaccagaaauacaaaguccucaaugaacugagcuccaucagcuugguagaugcaaauaccaagaaagagaagaaacucacugccaaaaucaaacaacugcuauacaaagaaggauuuaaaaagcacguuacagugucaaaaaccauggcccucaaaauccuaaaugacaacaacgugccaaccucagacauccucgggcucucuaccggcaaaaaguucgacaacucccucucuacguauaacucauggaagaaagccuuucccgaacaaaucgacaacccccacuacagacaagacuuggaauacaugaucgaguggucaaccguguucacagacaggaaaauacucguagagaaacuaaaagaaauagaguggcuccgccccgaacaaauuaaauucguucuagaacaccggcuaaccggauggggaaaacucagcaaacgacuccugguggaacucaaagacaacaaaggaaagagcaacauagacaacuuauucaacaccaagaaaaacuucaugcaaaucguaagccagcagguauacaacacgcagaucgaagcuaucgcccuaaaaaccacuaaaaaccaaucacuugauaauauccucgaagcagccuacacauccccagccaaccggaaggccauucgacaaacaaugaaggucgucaaugagaucguaacacucgccggaaaaggcacacaccccgacaagauuuuucuuaccuuucagcgaucuaaagaacaagaaggcaagcucaccaccgaccgcgcauccucgcuccucaagaucuaccguggaaucaaagauccacugugcaccaaagagcucgucgacgagcucuccaaaaacgugcgggcgaaccugaucaagaccaaggaguacuuauacuaccaacagcucggcagagacgcccugacaggcgaaaucauagacaaaaccgaccuuagaaacuacgcaguccuccacauuaucccgcgguccgugguagucgacgacucuauaaacaaccugguccucaccaaggucaaaaacgccaaagaguccauagucguccaauacggcucgaaaaacaucuccgacaucucgaugagcgugaaagauuucuggaacagacuacaaaaacucggccucuucucgaaaggcaaacucagaaacuuaacaacagaucucaccgaacuuaaccaauacgaaaaacaaggauucaucgcacgccagcucguagaaaccaaccaaauugucaaacugcucgcaacaauccuacaaggccaguucccccacaccaaaauaauagaaguccgacaagaacagauagccaacauacgcuaccaacucgacaucuaccgacuccgcgaccucaacguauacuaccgcggaauggacgcguaccuggccgcaguugucggaaccuaucucuacaccguuuacccgaaggcgcgccgcuuuuucguguacgguaaauaccuuaaacaagacaaaaacaacagggaagaaggccaauucaagacgucuggacacagcuucaauuuucuauggaagcuguuuuauggaggggaggacgagaucuauguccaaggcaccaacaacaucgccuucaauaaaaaggaucuacuacagaaaauaaaagaagugaacaacuacaaguuccaaaacgucucacuagccacagggaccaggcgaucagaccucuuuaagcagacaaucuacccccggcaagaacgagacguuaaaaagucacgaacauugauuacaaagaaaaacggucucuuuaccgacaucuaugguggauacacuggcaacgucaacucguacuucguccucguccaaaccaaauauaaaaaggaccccgacaaauucaaccucuacggcgugcccaaccgauacguagcuaugcucgaacaauccaaaaguaaaggcaacuaugagacuaaacugaaggaaguuauggaacccaucaucaagaacucgaacaaacgcaugaucggcuacaaaauccuaaaagaucgcauacuauacaaccaaauuauagaagauaacgguuacaaauucuucauaacguccucccaguaccgccacaacuuccgacaaaugauccucucagaccaauccaagaaaaucuugauggacuacgucuucgaccccaacuuuuaccgacacaagaaaacagaggaugugaacaacgauaaagacgccaaacucauaaaagucuaugacgaaauccuguaccaaauugaccauuaccuacaaauauucacuauaggccaccauaucgacaaacucaaaaaggcccgcccccuuuucgaaaaauguacccuugcagaaaaggcacaaguccugaacgacauacucaucauugccggcucaaaccaaaccgaacuagcgcucaagccccuaaagaccaccaaacuaacuuucagcaaacaaaauugcccccuuacaaaagaugcaaucuucuacuaccaauccccaacagggaugaucacccgaaaggaaucuaucaaggacauccucaaacaaaacauauga

SEQ ID NO: 6717 - RNA, 4173 nt, Artificial Sequence
  Cas9 variant
augucaaggaaaaauaucgucgaggauuacgcaaucagccuagacaucggcaacgcaucagucggcugggucgcguucaccccgaauuacagauugguucgcgccaaaggacacgaacuaauaggugcccgacuguucgagcccgcauccaccgcugaagaacggcgcauggcccgcaccacgcgacgaagauacuccagacgcagauggcgccucaggaugcuagauuccauguucgaccaagcacucucggaagucgacccgucauuccucaugagacgaaaguacagcuggguccaccccgaagacaagaacaacgaagcacacugguucggagguguccucuuugacagcaacgaacaagacaagagauucuacgaaaaguacccaacgauauaccaccuccgaaaaagccucauggaagaugacgaacgccacgauauccgagagguguaccucgcaauccaccacaugaugaaguacagagguaacuuucucacggaaggcgaacuagcccccagcaguguauucgacguagaagacuuccuaaaacucuuaaccgaaauccuccaauacgccgacgaaggcgaaaccgacgaagaccucgagcuccaagccgaugcgaacggccuaaccgaagcccucugcacuaccaaagggagucgcagcauacgcgccaagaaugccauuucaauacucaaagagggagccgcacucucaaaaaggcaggaggcgauaauaucagcgguguucgcagggcuagaagguaacaaguuagaucuaaccaaaguauucccaaacaaagaauacaccccggaagacaagaaaacccuagcccuuuacuucaacaaagccgacuacgacgaaaaacgcguggccaucggagauucaggccuacucgaagacaacgaaugcgacuuccucgauugcauccgcaggcaauauagcgcaauagcccucaaacagcucuuaggagauuucacguccauaucugaaagcaugugcgcaagauaugaacaacaccaaagaaauugggaccuaaucaaacgauacugccgagaggaguccaacgccgagaauaucaacaaaaacuacggcgccuuagucggaugggaaauaguugggggacaacgccgaucaauccgcggagccaaagauuacgaaaacaaacgaaaagcagcgaacaaguucuuugaggagcugaucaaaggguccgccuuaccagaccaggagaaagaacgacuacuacacgacauugagaacgacgagcuauuucccgugcaacgagacucagguaacggggucauuccguaccaacuccaccucaacgaacugaaaaagaucauacaaaagcagggacgauauuauccauuccuccucgaaaccuacauaaaagacgggaaagaagucaacaaauuagaaggauuacucgcguuucgaguaccauacuacgucgggccacucgucagccgugacgacaugcaaagcuccgacaaccgagaaaaucacuggaugaucaggcgcaaaaagggugucauaaccccuuggaacuucgacgaaauggucgacaaagacaaaagcgggcacgaguucaucaaaucacucguggggaccgacagcuaccuccucggcgaaaccacacucccgaaaaacucccuccucuaccaagaauuugaggucuuaaacgaacugaacaacguccgacucuccauccgcacgggcaaccacugggcggacaaacggcgaguacgccucggccauaacgaaaagaaacugcuacucgaagaacuauucgcaaaacaagcgaccguuacgaagaaagccgccgagaaccuccuacggaggacguacggcaauaccuaugaaaucaguggccucgcagacgagaagaaauucguuuccucccuaagcagcuacggaaaaaugugcagaacgcucaaagccucuuaugucaacagccacaaagacgugguagagaaaaucaucgaacuccagacugucuucgaagacaaaaagacacucaagcaccagcuacaacuccugggcgaacuagcggaaaccaacugcgaacugcuaagcaauacgcauuacacggggugggggaaacucuccagaaaacuccucacaagcaaggugguuguguguaagaucggcaacgacuucgcgccagcuaagcacagcaucaucgaaauaaugcgggaaacagaucggaacuuuauggaaauaaucacugacaaggaccuaggaguaggagaauggaucaaccaacaaaauguaggggccgaggacggaaacuccuaccaagacauaauagacgaccuaaggguaucaccaaaaguuaagagaggcaucaaccaggcgaucagaguuaucgacgauaucuccaaagcaguaggaaaagaacccucccgaauauuccucgaacucgccggcgacguccagcaaucagcgaggacagucucccgaaaaagccggcuccagggccucuacaagucugcgggccuccaaaaagaguucagggaccuggccgaaagucuaaacgaaugcucggacaacgaccuacgagacgaccgccuauuccuguacuacacccagcuaggcaaagacauguacacaggagaaccacucaaccucgaccgacuaucauccgacuacgacauagaucauaucauaccccaagcagucacccaaaaugacucacucgacaaccgaguacuggucgcaagaguugcaaaugccagaaaaacggauagcuuccaauaccuaccagaaaucgcuaaccgaaugcguaacuucuggcaagaacugcucgacgcaggccuaauaucaagagugaaauucgaucgccugaaccgccagaacgauuucagcucacacgaaaaggaaagauuuguacaacggagccugguagaaacccgccaaauaaugaaaaacguagccacaauaaugcgaaaacguuacggcaauagcgccgcuguaauuggccuaaacucggaacuaacgaaggagaugcgucaauaucuagguuucucacacaaaaaccgcgacaucaacgacuaccaccaugcccaagacgcauuaugccuggggauagccggccaauucgccguaaaccgcggauucuucgcgaacggaauggugucagacggagcgguaaacucauauaaccucuaccuacaggacuaccuccgcggcuaccgagagaaaauguccgcaggcgaacgccgccgcaacaaagcguucgguuucauugucggcagcaugaacucacaggacucagacaagcgcaucaacccaaaaaccggugaaaucgcaugggacgacgaggacaaagucuaccuaaggaagguuaugaacuaccggaagaugcugauaacgcaaaaaguaggggacagcuucggcgcccuauacaacgaaacucgcuacgguacuuccgcuaaagagggggucaacgggauaccuuucgauaaacauaagcaagacacggcccuauacggcggcuucucaagcgccaaaacagucuaugucguuuuaaucgaagcaaagaagaaaacccgucuugucaacauaaccaugcaagaguacgcagagcugggagaccaccccucagacgacgcacuaagagcaguacuagccaagaagaaacccgaauacgggaaagcgcgcauccugcugcgccauauuccaccaaugcaacuaauccgcuacggaggggcucucguuaccgucaaauccgccacagaacucaacaaugcccagcaacuguggcuaccauacaaagaauacugccuguucgacgauguaaucucgagcgcgaucgacgucgacgaagcuaggcugugccaaaugcuagacguaauacucgacgcuauccaaaaauacuaccccaaacagcgguuugacgaaacgggccuaucagccuuucacaacgcguucaacgaaguaagcgcggaagauaagaaacgaauaguaggggaaauggucggcaugcuccacgcagacgcgaaaaacgccaaccucaaagcauuggggauguccggccgauggggccgcaugaguaaccaaagcggcuacacauucgccgauuccgacgaguucauauuccagagccccuccggacuauuugaaaaacgcauaucugucggggaacucaagaaacgacgcgcaagauga

SEQ ID NO: 6718 - RNA, 4173 nt, Artificial Sequence
  Cas9 variant
augaaggaagugaaagacuauaucaucggacuugacaucgggaccaacucuugcggguacgucgucaccgacaaacaaaacaacauacuaaaauuaaaaggcaagaccgccauaggagcgcgccucuucaaagaaggagaagcugcagccgaccggcgagcguuccgcacaacccgacgucgacuggcccgcagacgcuggcgacucggacuccuagaggaaaucuucgacgaggagauggccaaagucgacagcucauucuucagacgccuaaaagagucggacuacagcccaaaggacagccgcaaacaguucaacaguauaguauucgaauccucggaagccgacaaagacuucuacgacaaauacccaaccaucuaccaccuucgaaacgcgcuaaugcacgacgaucagaagcacgacuuacgggaaauauuccuggcgguccaccacaucguaaaauaccgaggcaacuuccuccgcgaagauucaguaaaagcauucaaggccgccaaauucacgcuacaaggugaagacggcaucggaccugucgacaagcucaaugaccuacucaaagaaauuuacauugaagcagccccugaacuagccaccgacaaccucagcaaaaucgaagagauuaucaaggacaagaaacuauacaaacaggacaaacuuaaacaaguggcaacccuccugacaaaagaagccgacacaaaagacaaagcaaaacuaaacaaggacguagccaagcaaguggcaaacgccuucaugggguacaugauaauauucgacacaaucuucaaucucucggacguagauagcaaagacuacaaaguuaaguucuccgacgcaaacauagacgagaaacuagacacccuaaccagccuacucaccgauaaacaaacagaguucguccucgaacugcaaaauaucuacaauaccauuguucuaaacgaaaucgucccugauggaaaaagccugucagaaagcaugguaaagaaauacgacgaccacaaagaagaccuuaaacuauucaaagcguaccucaacucuuuaacagauguaaagaaagugaaagaacugaaggcggcguacguccucuacguaaacaaccgcaaagcaaaccuucucgcugccaaaaagcuacuaggaaagaaagcagauaacaugaacaacuucgagaucuucagcaaauucguggcagacaaucuagacgacagcgaacuagcaaacaagaucagagccaggcuugaccucggcgaguuccugcccaaacagcgcacuaaccaaaacggcgucauacccuaccaacugcaccaaguagagcuaacacaaauccucgagaaacaagguaaguacuauccauuccuaaucgcaccgaacccaguagaaucgcaccguaacaacgcgccauaccgaaucagcgaacuggugagcuuccgcgugccauacuacguaggaccgcuaaucgauccgaacaacgcagagucagaacaagacaaggccaauuccagcuuugcguggauggugagacagaaacaggggcagaucacgccauggaacuucgaagaaauggucgacacaacagaaagcgccaacaaguucauaaaacgaaugacaacaaaggacacauaccucuugggggaggacguccugccagcguccagccuaaucuaccaaaaauucgugauacucaacgaacucaacaauauaaaagucaacgguauaaaacucaccucagaagaaaaacaccagaucuucgacgagcuguucaaaguacaaaaauccguaagccugaaaaaucuagucaacuuccuaacagcucacggcugcguggcaccgaauguaaccgggcucagcgacggcacaaaguucaacagcuccuacuccacuuacauagacuaccggaaaaucuucggcgccgaaaucgacaacaaagacaaacaagcagacuucgagaaaaugaucgaaugguccacuguguuugaagaccgaaagauuuuuaaacgaaaacuggaagaaaucacauggcucacacccgaccagaucaaacaaguaagcucgaaacgcuacagcggauggggacgacucucuaagaaacucuuaacccaaaucaccgacgaaaacgggguaaauauccuacaacgccuauggaacgaauccgagaaucucaugcaaauccuaagugaccccgucaucaaagagaaaaucgucgccgccaacagcucauucaccaaagcaaccgacauggaagacauacucgcagaagcauacaccagcccccaaaacaagaaagccauacgccaaguuaugcgcguagucgacgacauaaucgccgcggcccacggcaagaaacccagucaaauugcaaucgaauuugcgcgggaggaccaagacaacccccaaaugacuaaaucacgcaaagcccagcucgaucaaauuuacgcaaaaaucucagacgaguuccuugauaaugcgguuaaaaaugaacucaaaaauaugaaagacaacaaaccccuagccaaagacaaaguauuucucuacuucaaacagaugggccgagacgccuauaccggugagaaacugagccucgacaacuuacaagauuacgacaucgaccacaucuacccgcagagcuucaucaaagacgacagcuucgacaaccgcguccuuguccaacgugcagucaacaacggaaagucggacaacgugccaguccuccuguucggaaacaaacaagccgccgaccuaggcaugacgauacgucaaauguggaagaaauggcuagagcuuggcuuaauaagcaaacgaaaguucaacaaucuaauaaccgauccggagaaaaucuccuccuacauggcaucaggcuucgucaacagacagcuaguggaaacaagccaagugauaaaacuugucgcaaacaucuuacaagcaaaacuacccgacaccgaaauaauugaagugaaagccucguacaacaguauccuccggaaggaguucaaccuuuauaagucacgagaagucaacgacuaccaccacgcgauugacgccuaccucacgaccaucgucggcaauuaccuauaccagguguaccccaaacuacguccauacuucgucuacggacaauucaagaaauucggaaaagccgaaucgaaagaagacgauccggucaagaaaauaaaacaguucaacuucauauaucaacuacuauggggaaaagacgacgcgaucugcaucucacauaccgaucaacaagucuucucacgaagcgacaucaucaacaaacuaacgaccgcguacaauuuuaaauacaugaauguaagucaagaagucuacacaaacuccaauaacguauucaaacagacgguauucccaaucauagaacgugacaccgccaaaagccggagccuuauucccaagaaacucgaucggcccacggacaucuacggaggcuacucgaacaacaaugacgcauaccucgcgcucgucaaagucgacaagaagaaaggcagcgaauaccgagugguggguauucccaugcgcgcggccgcaaugcucaaagccaguaaaaacuacgacgaggaccugcgaaaaguaaucgagcccauggucaugcucgacaaaaacggaaaagccaaacggggaauagaaggauuccgagugcucgucggcaaaaugccauucaaacaagccguccuagacggagacaagaaauuuaugcucaccggcaccaaugacaugcccaaccucaaacaacucguccuaucccaacaaaauaugaaguauauucucgacuacauagaugacauagacugccggaaacacaaauucggaaacaagacacaggauggcaacaagugccuccuagaggucuuugaugaaauuauccaaauagucgauaagcacuucgagcuuuucgacaaccgcucauucagagagaagcuccguaacucgcgcgucaacuuuauaaaccuagcacucagcaagaaagccgaggcacuccucgcaauauuaaacggccuacacgcaaacagcaugcgcacuaccauuaaagaacugaaaaucucagaccucggacgcauacagagcagugucaucuccccagaagcccagcuuaucuaucagagccccacaggccuguucgaacgccgcgucaaagucaaagaucuguga

SEQ ID NO: 6719 - RNA, 4176 nt, Artificial Sequence
  Cas9 variant
auggaaaauaaacaauauuacauugggcuagacgucgggaccaacagcgucgggugggccgucaccgacacgaguuauaaccuacugagggccaaagggaaggacauguggggcgcacgauuguucgagaaggcaaacaccgccgccgagcgcagaaccaaacguaccucccggcgaaggagcgagcgagagaaggcacggaaagcuaugcucaaagaacuauucgccgacgaaaucaacagagucgaccccuccuucuucauaagacuggaggaaucaaaguucuuccuugacgaccgcucggagaacaaccgccaacgguacacccucuucaacgacgccaccuucacggacaaggacuacuacgaaaaauacaaaacgaucuuccaccuccguagugcccugauuaacucggacgaaaaauucgacguacgccuuguguuccuggcaauccuaaaccucuucucacaccggggacacuuucuaaacgcaagccuaaaaggcgacggggacauacaaggaauggacguuuucuacaacgaccuggucgaaucgugcgaauacuuugagauagaacuaccacgcauaaccaacaucgacaacuucgagaaaauacugucacagaaaggcaaaagcaggacuaagauccuagaagaacugucggaggaacucucaaucucgaagaaagacaagagcaaauacaaccugaucaaacuuaucucaggccuagaagccuccguagucgaacucuacaacaucgaagacauccaggacgaaaacaagaaaauaaaaauaggcuuucgggaaagcgacuaugaagaaagcagccugaaggucaaagagauaauaggcgacgaguacuucgaucuuguagagcgggcaaaauccguccacgauaugggccuccuuucgaacaucaucgggaacuccaaguaccucugcgaggccagggucgaggcguacgagaaccaccacaaagaccuccugaaaauaaaagaacuauugaaaaaguacgacaagaaagccuacaacgacauguuucgcaaaaugaccgacaagaacuacucggcguacgucggcuccgucaacuccaacauagcaaaagagcgacgcucgguggacaaacggaaaaucgaggaucuauacaaguauaucgaggacacggcccucaaaaacauccccgaugacaauaaggacaagaucgaaaucuuagaaaagauaaaacucggagaguuccucaaaaagcagcucacggcguccaauggcgucauaccgaaccaguuacagucccgagagcuaagggcaauccuaaagaaagccgaaaacuaucuaccguuccuaaaagaaaaaggggagaaaaaccucacggucagcgaaaugauuauccaacuauuugaguuccagauaccguacuacguaggaccccucgacaagaaccccaagaaggacaacaaggccaacagcugggccaaaauaaagcagggaggacgcauccucccauggaacuucgaagacaaggucgacguaaaggguagccgaaaggaguucaucgagaaaaugguacggaagugcacauacaucucugacgaacauacccuccccaagcaaucgcugcucuaugaaaaauucaugguccucaaugaaauaaacaacauuaagaucgacggagagaaaauaagcgucgaagcgaaacagaaaaucuauaacgaccucuucguaaaagggaaaaaggugucacaaaaggacauuaagaaagaacugaucagccuaaacaucauggauaaagacucaguccuuucuggaaccgacaccguaugcaacgcguaucugucuagcauagggaaguucacaggcguguucaaagaagagauaaauaaacaaucgaucguagauaugauugaagacauaaucuuucuuaaaacagucuacggagacgaaaaacgcuucgucaaagaggagaucguagagaaauacggggaugagaucgacaaagacaaaaucaagcguauucucggcuucaaauucuccaacugggggaaccuaagcaagucguuccuagagcucgagggcgcggacgugggcacgggcgagguccgaucgaucauacaaucucugugggaaacaaacuuuaaccuaauggaacuccucagcucacgcuucaccuacauggacgaacuagagaagcguguaaagaaacuugaaaagccgcuaucagaguggacaauagaggaccuagaugacauguaccuaucaagcccuguaaaacgcaugauauggcagucaaugaaaaucguggacgaaauccagacagucauaggauacgcaccgaaacgcaucuucgucgaaaugacccguucggaaggagaaaaagugcggaccaaaucccggaaagauagacugaaggaacuguacaacgggaucaaggaagauagcaagcagugggugaaagaacuagacagcaaagacgaaagcuacuuucgaagcaagaaaauguaccuguacuaucuccaaaaaggaaggugcauguacucaggagaagugauagagcucgacaaacuuauggacgacaaccuguaugacauugaccacaucuacccucggagcuucguaaaagacgacagucuagacaaucuuguacucgugaagaaagagauaaacaaccggaaacagaacgacccaaucacgccccaaauccaagcgagcugccaaggauucuggaaaauccuccacgaccagggauucaugaguaaugaaaaauacagccggcucaccaggaagacccaggaguucagcgacgaagaaaagcugucuuucauaaaccgacaaauaguugaaacggggcaggcaacaaagugcauggcccaaauacugcagaaaagcaugggcgaagaugucgacgucgucuucagcaaggcccgccuaguaagcgaguuccggcacaaguucgaacuguucaagagcaggcucaucaaugauuuccaccacgcaaacgacgcauaccucaacauaguaguagggaacucguacuucgugaaauucacccgcaaccccgccaacuucauuaaagacgcaaggaagaaccccgauaaccccguauacaaguaccacauggacagguucuucgaaagagacgucaaauccaaaagcgaagucgcauggauugggcaaucagaagggaauagcggcacuaucguaaucgugaaaaagaccauggcaaagaacucgccccugaucacaaagaaaguagaagaaggccacggauccauaaccaaagaaacaaucguaggcgucaaagaaaucaaauucggccgcaacaaagucgagaaagccgacaaaaccccgaagaaacccaaccuccaagcguaccgacccauaaaaacaucugacgaaaggcugugcaacauuuuacgauacgggggcaggacaucaauaagcauaagcggguauugccucguagaguacgucaaaaagcguaaaaccauacgaucccucgaagccauaccaguauaccugggacgcaaagacagucucagcgaagaaaagcuacuaaacuacuuccgauacaaccuaaacgacggagggaaggacucaguaagugacauccgacuaugccuaccguucauuucaacaaacucacuggugaaaaucgauggguaccuauacuaccucggcggcaaaaaugacgaccgaauccaacuguauaaugccuaccagcuuaaaaugaagaaagaggaaguggaguacaucagaaaaaucgagaaggccguuucaaugagcaaguucgacgagaucgaccgcgagaaaaaucccguccucacggaagagaaaaauauagaacuauacaauaagauccaagacaaauuugaaaacacagucuuuagcaagagaaugagccucgugaaguacaauaagaaagacuuaucguucggugacuuccucaaaaacaagaaaagcaaauucgaagaaaucgaccuagaaaagcaguguaaggugcuguacaacaucauauucaaccucucgaaccuaaaagaaguagaucuguccgauaucgggggaagcaaguccaccgggaagugccgaugcaagaaaaacaucaccaacuauaaagaguucaaacugauacaacaguccauuacggggcuauacagcugugaaaaggaccucaugaccauauga

SEQ ID NO: 6720 - RNA, 4176 nt, Artificial Sequence
  Cas9 variant
augaaggaaauuaaagacuacaucaucggacucgacaucggcaccaacaguugcggcuacgucgucacagacaagcaaaacaacauccucaaacugaaaggcaaaacagcuaucggagcccgcuuguucaaggaaggggaggccgccgcagauagacgcgccuucagaaccacccggaggcgacucgcccgucgccgcuggcgccucucauugcuggaagaaaucuucgacgaggagaugaacaagguggacccaucauucuuucgccgacucaaagaaagcgacuacagcccaaaagacaggcgaaaacaguuuaauuccauuguauuugaaagcucggaggccgacaaggcauuuuaugaaaaguaccccaccauuuaccaccuacgaaacgcccuuaugcacgacaaccaaaagcacgaccuacgcgagauauuccuggccguacaccauauuguaaaguaccgaggcaacuuucugcgagaggacagcgucaaagccuucaaggcugcaaaauuuacgcuccagggcgaagacggaaucggccccguagacaaacucaacgaccuccucaaagaaauauacaucgaggcugcccccgagcuugcgacggacaacuuaucaaagaucgaagacauaaucaaagacaagaaacucuacaaacaagacaaacucaagcaaaucgccaaucuacuccccaaagccgucgacaguaaggacaaggccaaacugaacaaagauauagccaaacaggucgcgaaugcgcugauggguuacauguuccgccucgacaccuuauuuagcuucaccgacguggacgugaaggacuacaagcugaaauucucagacgccaacauugacgagucccuagacgcuuuaacaucguuacuaaccgacgcacaaaucgaguucguccuugaacuacagucgaucuauaacacgaucguacugaacgaaaucgucccggacggaauguccuuauccgaaucaaugguaaagaaauacgaugaccacaaaaaggaccucaaacucuacaaagaauacauagacucccuauccgaccaaaagaaagccaaacaacuagaggcagccuacgcacucuacgucaacuaccguaaggcagaccuacucgcagcaaagaaauuguucgaaaagaagaagaucggagacaaaaaguucgucgacguaauaucaaacuuugaagucuucggcaaguucguauccgacaaccuagacgacuccgaacucgcgaacaaaaucaaggcacguuuggaccuaggugaauuucugccuaagcaacgaaccaaccaaaacgggguuauacccuaccaacuucaccaagucgagcugacacaaauccuagagaaacagggcaaauacuaccccuuccugaucacaccuaaccccguagaaucccaccgcaacaacgcacccuaugaaauaucggaacucgucuccuuccgcguucccuacuacgucggcccccuaauagauaaccaauccaucaaagacaaacaaaauaaaaacaaauucgcauggauggucagacaaaaacaaggccaaauaacgccuuggaacuuugaagagauggucgacacuaccgaauccgcgaaccaguucaucaaaagaaugacccgaaaggacacuuaucuccucgcugaagacguacucccuaaauccucacuuauuuaccagaaauucaugauacuggacgaacuaaaccguauaaagaucgacggaaagaaacugacgucaaaauuaaaacacgacaucuucgagaaguuauucaagaaacaaaaguccauaaaccucgacaauuugaaaaacuaccuacuagcagaagguaauauacccggacucauugaggggcucuccgacggcaucaacuucaacaacucguuuagcaccuacauagauuaccgcaacaucuucggggacgagauugacaacccgaacaaacaagccgacuucgagaagaugauagaguggucaacggucuucgaggaccgcaaaauauucaaacgcaaacuaaaagaaauaaccuggcugaccccugaacaaauuaaacaggucaguuccaagcgcuacucgggaugggggcgccuauccaagaaacugcuaacccaaauaaccgacgagaacgguguaaacauacuccaacgacucuggaacgagccggagacacuaacagaggugcuggccaacccaguaauuaaacgcaaaauaucagaagcaaauagccuauucguacagaucaauaaggucgagaacauccuugacgacgccuacacuagcccccaaaacaagaaagcuauucgccaagucauccguguagucgacgacaucauugcagccgcgcacggcaaaaagccaucacaaauugcaaucgaauuugcacgaucgagccaaaacaaggcgaaggucccagacacacgcaaaaagcaacuggacaaaaucuacaacaaaaucagcuccgaaauccuagacagcucgaucaaaaaugagcucaagaaccuaaaaagcaacaaguacuuguccaaagacaaacucuuccuauacuucaagcaaaugggacgagacgcuuacaccggagacaaauugucuuuagaccagcuccaaaacuaugacaucgaccacauauucccccgcaguuucaucaaagacgauucccuugacaaccguguauuaacacaaaagcccauaaacgcuaaaaagagcgacuauggaaucccagcccuggaguucggcaauaaauacgucccagaccuggguauaaccguuaaagaaauguggaaacuuuggcaggaaaacgggcuaaucuccaaaagcaaacucaucaaccucugcacgaaccccaagaagaucggauccaaaagagccucuggguucaucaaucgccagcuagucgaaaccucccaagucaucaagcuagucgccauuauucugcaggcagaguucccugacacagaaauaauagaagucaaggcccuccaaaacacaacucuacgcgaaucauuucaccucuacaaaaaccgcucagugaaugacuaccaccaugccaucgacgcuuaccucacgacaaucgucgguaacuaccuauaccaaguguacccaaagcugcgcccuuauuucguauacgggcaguucaagaaauucaaucaggagaaaaauaucgacauucucaaaagacucaaaaauuucaacuuccuacgacaacuuauauuuaacacggacgacaacauauacaucuccgguaccaaggaaauaguauucaacaagaaggauaucauacauaaacuagagaccgcauacggcuacaaauauaugaacauuucgcgcgaguguuaccaagagaccagcagccucuucaaccaaacucucuacgcucacaacuccagcgucaaaaacucccugauccccaagaagaaaggccuccccaccgagaucuacggcggauacucgggcaauaaagacuccuucuucguccucgucaaaaucgucaagaaacgcaccaaccucuaccgcauagucgggauaccuacucgcgaacucgccaaacugaacucauccaacaacuacaaccaagcccuaaacaaaaucgucgaaaguaaacucugccugaaagaaacagaaaguuucaaaauucuaaucaaacgucuccucuacgggacccugauaguggacaauggccaaaaauuccggauaggcagcuucaaagaaaaacauaacguccaacaacucguccuucaacucaaaucgaugaaauacauaaaauuuuacaucgacggagggcaaaacuauuucaccgacgucgaacgcaaaaagcuggaaaaacaagaccgcgauaaaugccuacuguacgucuucgacgacaucaugaacgucguuaacaaacgcuucacucucuucgacaugucgaaauacgaaaaagacggcgauagucuccgcgaaaaauucaacugccuagacuucaacgacaaagucucgauacucuccgaucuacucaaagcauuccacgcgaacuccgaccgcacguccaucacuaagcucaaaaucacuaacuugggacgucaccaagccgggaagaacggcauuacccucacgacuaacgcccagaucauauaccaaucaccaaccggucuauucgaacgucgaaucaaaaucaaggaccucuga

SEQ ID NO: 6721 - RNA, 4176 nt, Artificial Sequence
  Cas9 variant
augaaaaagauccuaggccuugaccuagggacaaacuccauuggcugggcacuggucaacgaagcagaacacgagcacgaacaaucgagcaucgucaaacuaggaguccgcgucaacccauuauccgucgacgaaaagaccaacuucgagaagggccgcccccucuccaucaaugccgaccgcaccucgaagcgaucugcacgacgaaacuugcagcgcuucaaacuacgacggaaaaaccugauaaaucugcuccuaaaacaccacaucauauccaacgagacaauccucacugaagucgguaaaaacaccacccaccaaacccuaaaacuacgcuccaaagccacacaagagaagauaucacucgaggaguucgcacgcauccuacuguccaucaacaaaaagcgcggauacaaaucgucacgaaaggaaaagaacgaagaugaaggauucaccauagacgggauggcaaucgcgaaggaacucuacgacaaucagcucacgccgggccaauacguguacaacaucuuacaggauggcaaaaauuacaucccugauuuuuaccguuccgaucuacaggcagaguucgaugacguauggcaauuccagaagaaauucuacuccucgaucuugacggacgaguucuaucucaaacuuaaagggcaggggaaagaaaacacccgcaaacuuuuccucgcgauccaccaaguuuacacagccgaaaauaagggcaagcgagacgccgugaaacuacaauacuacaaauggagaagugaagccguuaagaagcaacucuccaucgaagaagucgccuacgugcucguagaaaucaacaacaacaucaacaaaagcucgggauaccucggggcuaucuccgaucguaguaaagcccucuauuucaacaacgaaacaguaggcgaguaucuauacggccaacucgucaaaaaccgccacaacucauuacgcaaccaaguauucuaccgccaggacuaccucgacgaguuugagaagaucugggaaacccaggcaaaguucuacgacgagcuaacaaacgagcuaaaacaagaaauccgggacgucgugauuuucuaccagcgcaagcugaaaagccaaaagcaucugaucuccgauugccuauuugaaaaacaccauaaagccauucccaagagcucuccgcuauuccaggaauuuaaaauauggcaaaaucucaacuaccuagaguucgugcacacacagucgaaggagaaaauuuucuucuccgaacuggacgacgagacccgucaguuuguauucgcagaacuaaacauccggggcacccuuaagauaaaggagaucaagaaacuaauaggccuggaaacaccagucuacuggaaauccaacuucgacgaaauagaagggaaucggaccaaccagguacucuacaacguauaccaaaacaucgcugacgaccucggauacggauuugacugguccaagaaacacgccuucgagaucaacgcagaacuacaggccauauuuaaagacguuggcaucgacacagccauacucaacuucgacgcaagcaucgaggagaacgacuucgacaaacaaaaauccuaccaacucuggcaccuacuauacuccgcagaggacaccgauaaagccaccgaggaagauaaacucauuuacgggaauaucaacacaaaacucaagaaacagcuacaccagaaauacggguuugaggcaaaauacggaaaccuccucgcgaauaucagucuccaacaggacuacggcaaccugagcgccaaagccaucaagaaaauccugcccuaccuagaaucagguaacucguucuacgaggcuugcacgauagucgguuacaaccccuccaacucgcucaccaaagagcaacaacaaaaucgcaaacugaaagacaaacuugaacugcugcccaaaaacagccucagaaacccgguuguagaaaagauccuaaaccagaagguaaacuuaaucaaccaacuaaucgacgaauauggcaaaccggaugaagugcgcauagaacucgcccgcgaacuuaagaaaagugccaaacagcgcgccgaccucaguaaacacauaaacgacgcaacccucaaaaaccaaaacauucgaaaaacucuacaaaaagacuuuggcauccaaaacccaagcaaaaacgacguaauccgguacaagcucuacgacgaacuaaaagacaauggcuauaagacacuuuucacaaacaaauacauccccaaagagcaacucuuuucaaaagacguugauauagaacauaucauccccaaagcaauccucuuugacgauucauuuuccaacaagaccuuggcauaccgaaauguuaaucucgcaaaggccgaugcgacagcguucgacuuuaucucguccaagcaccucgacgaccuggacaacuacaaggcccgcgucgaaacccuauuccaaaguaaacgcaucuccaaaggaaaguacaagaaacuucucaugacccgccaaaaccucccugaagacuucauagaaagagaccuacgaaacucccaauacauagcuaaaaaggcaacugcgaugcugaaagagguauucagguccguagucccgaccucaggccgaauaaccgacaaacuacgcgaagacugggaccucgucaacgucaugaaagagcucaaccuccccaaauaccgaacccucggccuaacugaguucaucgaacgaaagaacggcaacaagaucgaacagauaauagacuggacuaagaggaacgaccaccgacaccaugcaauggacgcucugacagucgccuucacaacccacaaucacauacaguaccucaacaaccuaaacgucacacacgggcucaacggaguggacaccgaccacgaaaagagccgacucuacgcaaucaagcaagcgaucacaaaaguauacauagugggcaagaccaagaagcgaaaauucaucccgccgauggaaaacuuccgaucacacgcgaaaaaucaccucgaagggauacuuauuuccuucaaaaacaaaaacaagguugucacaaagaacaaaaaucggaccaaaacaaaaaccaaaggcguguucaacgagaaaauacagcuaacaccuagaggccaacugcacaaagaaaccauauacggacacgcaaagaaggucaucgucaccaaggaaaaaguauccuccaaguucacccacgagaaaauccuccaggucacaaaacccgcauaccgagaagcacuccuaaagcgccucgccuccuuuaaaaacgauccaaagaaagcauucucaggcaaaaacgcccuuuccaaaaacccgcuauacuuugacaucaccuccggaaagaaagucccagacacuguuaaacucuccuacuucgaaaauuccuacguaauccggaaagaaguaaacucagacaacuucaaaaacgaaaaaucacuccaaaagguacucgacguugguauacgacguauacucgagaaacgacuagcagacuacaacgguaacgccaaagaggcauucucaaaccuagagaaaaauccaauuuggaaagacaaggaaaagggcguuugcaucaaaaaggucagaauagaagcacucaaaaacgcggaaccacuccacgucaagaaagaccauuuaggcaaaaucauacuugacgacgaaaacaaauccacccccgucgacuucaucagcaccggcaacaaccaccacguggcgaucuacgaagauaaagacggcaaacuccaugacaaaguggugucguucuacgaaguagucucgagagugaaccuaggauuacccaucaucgauaaaucguucaacucacaccucgacuggaaauuccucuucagcaugaaacagaacgagauguucgucuuccccuccgaagacuuuaacccgaaggagaucgacaucggcaaccccaaaaacaacgagcugauuucaaaguaccucuucaggguacagaaauuuucaaagguaaccuacggaaacagcgcaguucgagacuaugucuuccgccaucaccucgagacagaauugauagacaagaaggaacucaaaggaauaaccuacuaucaauuaaagucgauaggaaugcucgagaaacucgugaaaguacguaucaaucacauaggcaaaauaguccacaucggcgaguauuga

SEQ ID NO: 6722 - RNA, 4176 nt, Artificial Sequence
  Cas9 variant
augaaaacaauucugggccuggaccucgggaccaacagcaucgguugggcacucguuaaagaagcggaaaacgaaaacgagguaucggacauaaucaaacucggcguccgggugaacccccuaaccguagacgagcucaccaacuucgagggaggcaaagccuacagcaacaacgccgagcgaacacugaaacgaggcgcucggcgcaaccuucaacgcuauaagcugcgccgagagaaccucauagaaauacuacucaaaaacggccucauaaauaaagacaccgcgcucaccgaagucggcaaagaaacaacacaucaaacccuaaaacugagauccaaaagugccaacgagaaggucaguuuagaggaccuggccaagauccucuugucgaucaacaagaaacgaggcuauaaaucgucacgaaaagugaacgccgaggaugauggggucgccaucgacgggauggagguggccaaacugcucuacgacgaaaacaugacucccggggaauacguacuacggcuacucgagucgggaaagaaacaccuucccgacuuuuaccggucugaccuccaagaagaguucaaccugguuuggaagaaacaaagcgaguuuuacccgcucauacucacaaaagagcuguucuucgaacuucacgggaaaaacaagucgcagacuugggcaaucugcaaggaaccccucggcauuguuggcguaaaacucaaaggguccgccaaagaacagaaauucgcccgcuacaggcuccgcaaagaggcccuaacccaacagaucgaauuggagcaccucgcgauuguacuccaagacauaaacaacgacagcaacaaguccucaggcuaucuaggggcaaucuccgaccgaagcaaagaacucuucuucaacaaagagaccgucggacaauaccaguacaagcagcugcagaaagaccccaacacgucccuaaagaaccaaguauucuaccgccaagauuaucuagacgaguucgaaguaaucuggagaaaccaggcgaaguucuacccgcagcuaaccaacgaacugaaacaggaaauccgcgacgucguaauauucuaccagcgcaaacucaaaucccagaaaaaccucaucaguuuuugccaauucgagagcacccagcagaacuacgucgaaaaagagaccggcaaaaccaaaauccgcacgauuggacgucgggucauaccuagaucaucgccccucuuccaagaguucaaaaucuggcagagccuaaacaaucucaaguucgucaauuccgagucaaaccaaauaauccaauucauagagcucgaagacgacgugaagaaggugguauuugacgagcuuaaccuaaggggcgaccuuaaaccaaaccagguccucaaaauccucagcaaguacaugaagaucggcaaacucacccaguggaaaugcaaccuugaagaaaucgagggcaaucgcacaaacagcgcacuauacaacgucuuccaaaugauagccgaagaggaaggauacgguuucaacugggggaagaaauccgcauuagagaucaaaucggaacugaaggccauauucucuagcauuggaauaaacgacagcauccucgacuucgacuuuuccaagaagcuagaccagcaacucuccuaccaacucuggcaccuccuauacuccgccgaagagggcaacagcaaaauaacagaagaagacaaauucaccuacggcaacacgggggucgcacucaaaaagaaacuacaccuuaaguucggauucaagccagaauacagcacacuaaucagcaaccuaagguucaccuccgacuacggaaaccuguccucaaaagccauaucaaagauacuccccuuccuacgcgauggcagugacuauucaaaagcaugccaauacgcuggauacaaccacuccaacucgcucuccgcggacgagcuggacaaccgcgaacucaagccgaaguuagaacuacucaaaaagaacucgcuacggaaccccgugguggaaaagauccuaaaucaaaugguuaacguagucaaccaagugauagacaacuacgggaaaccggacgagguccgaauagaacuagcccgcgaacugaagaaaagugcuaaagaaaggagucaaaugacaaagaacaucagcgacgcaacccgccguaaugcggaaaucaaaaaguaccucuccaaagaguucggcauuccaaaccccaccaaaggggacgucaucagguacagacuaugggaggaacucgcgucgaacggcuauaaagaucucuucagggacaaguacauccccaaagaaaaacuguucuccaacgaaauagacaucgaacauauaauacccaaggcccuccuguucgacgacucguucucgaacaaaacccuagcguucaagguagacaaccucaagaaagccgacagaacagcguucgacuucauguccacggacuuuuccaaagacguagacucuuacauagggcgaaucgaaacccuccacaaagacgggaagaucuccucuaguaaauacaagaaacucaugauccccaaaagcaaacuggucgacggguucaucgaacgagaccuccgcaacacucaguacauugcaaagcaagcccgcaagaugcucuuagaaguuuucaaaacgguuguaccuaccacagguaaaauaaccgacaaauugcgcgaggacugggaccugauaaauguaaugaaagagcucaauuucccaaaauacaaagcgcucgggcucacuaagaaaauagaaagauucgacgucggcucagagaagaucaaguccauuaacgucaucgaagguuggagcaagcgaaacgaccaccggcaccacgcaauggaugcuuuagcaguagcauucacgacgcacaaccacauacaguaucugaacuaccuaaacgcacggaaggacauacaucacgaaaugcauggaacaauaaaguccauagagaaccaaaucauuggcaaggacguaaugggaaaacgacgcuucauaccucccauuagugaccuccgcaugaaggcaaaacuacagaucgaguccauacucaucucguucaaaaacaaaaacaaaguaguuacuuggagcguaaacaaaacaaaacugaagggcaaagacaacuacaauaagcgccgacagcuaacaccccgcggacagcuacacaaagaaaccgucuacggcaagauaaaguuaauugaccccaaaccgcuaaaacuaaacaacaaguucacccucguaagagcuagcaugaucguggacaaaguccaccgagaaauaguacuccagcaccuaagcaaauacgacaacaacagcgaaguagccuucgacucaaaaacgauaaaaaucgauccaauccucaucgaaggaaucggacuaaaagaggucgucugcuacgaggaugucuucaaaauccgaaagaaaauaucaggcgacaacuucaaaaacgagaagcaccuagaaaagguaauugacgagaaagucaaacagauauugaaggaccgaguaaucaaauuccaaggaaacuucaaggaggcguucuccaacuuggaggaaaaccccauauggcuuaacaaaagcaaagggauagcggucaaaucgguagcgaucaagggaguuaacaacgccgaaucccuacacgagggcaaggaccauuucggggaccagauacucgacaagaacaagaaacaaaucccaguugacuuuguguccaccggcaacaaccaccacguaggcauauacgaagacaaagacggaaaccugcaggaacgggucgugagcuuuuucgaagcgguaacccgagucaacgaaggccugcccaucaucgacaaaaccuacaacagugauaucggauggaaguuuaaauucacgaugaaacagaacgaaauguucguguucccgagugacgacuucgaucccaacgaguucgaccugacagacgggaaaaacgccgccaagaucuccccgaaccuuuacaggguccagaagaucgcaacaaagaacuacauguuccgucaccaccuagaaacagugguuaccaacgaccuggaguucacuuacaagucaauacgcaguacaggauggcuucgaaaccucguuaaaguccgcauaaaccaccucggcgaaaucguauaugucggagaauacuga

SEQ ID NO: 6723 - RNA, 4176 nt, Artificial Sequence
  Cas9 variant
augaaaaagauacucggccucgaccucggcacgaccucaauaggcugggcacuuguuaacgaaaaggaaaauaacgaggaacucucaucgauaauacggcucggaguucgcguaaacccccuaaccgucgacgagaaguccaauuucgaaaaaggcaaagacaucacaacuaacgcggacagaacaaaaugccgcagcgcacgacgcaaccuccagagguuuaaacugagacgugaagcacuggcagacugccuuaaacgacauggacuaaugaccgacgagacgccccucugugaaacgaacaacucaaucaucuucaagaccuacuccaaccgcgcuaaggcaguaugcgaaaagaucgcgcucgacgacuucgucaggguccucuucaugauaaacaagaaacgcgguuacaaaucaagucggaaacuaaacacagacgacgaaggcacucugguagacggcauggacgucgcaaaacucuuauacaacgaacagauuaccccuggcgaauaccuucuucggcuuuucaaaaaggggaagaaaacccgaccagacuucuaccuaucugaccuaaaagcagagcucgagcgcauaugggacuuccagcgaaccuucuacccggaaauccucugcaaugcauuaaaagaagaccuuaagggcaaaagccggacgcaauccucggcaauauuuuacgcaaaguacaaagugagcaccgccaagaucgcggggaaggacaaacgccugcaagagcucacauggcgcaccgacgcccuacgaaagcaacucaccaucgacgaaguagcauacguaaucugcagcauaaacggagagguaaacggauccucccaaagacucuccaugauauccgaccgaagcaagcugcucuacuucaaccaccaaacgaucgggcaguaucucaugcaacgacucgaagaaaaccccaacgcuggccucaaaaacaucauauucuaccgacaagacuacgaagaugaauuuaaugauaucuggaacucccaagcuaccuaccacaaagaacuuaccccggagcucaagaaggaggucaaagacauaauuuucuaccagcgcgggcucaaaaguugcaaauggcucaucaacuacugcgagcucgaacacgaggagauagaagucaaaacaccagaaggaaaacuccgaaagauaaccaucggaucaaaaaccugccccaaauccucaccccuauuccaagaguucaaaaucuggcagguccuuaacaaccuacaaguaucgccacucaacuccagacgaaaggcaaagaggaagaaagacgaggaaccgucccucuucagcgacgaggacaugaacacagcuuguagauaccuaaacgaagaggaaaaacugacccucuucaaagaacuaucgauaaagaaagaacuaaagaagaaagacgcccugaaacuacuauucgaaaauuacaaagagcuggaccuuaacuacaaaguuauaucgggcaacguuaccauggcaaaucuguaccgcgcguuccaggacaucaucucgcuaacgggcaacggugaguucgauuuccaggccaugccggccgaagaagcggagaaaacuguagaagaaauauucggaggccugggcuacaaaaccgccuucuuacacuucgacgcaagucuacacgacaaagaguucgaacgccaaccggcauaccgccuauggcauuugcucuacucguacgccggcgaccaaagcaaaaccggcaucgaagcccucguaaaacgaauacaggaacuaugcggauucgaaccagaguacgcaaggauacucgcuaacaucuccuuuauccccgauuacggcaaccucuccuccaaagccaugcgaaaaauccugccguacaugcaggauggcuacgaauacuccgaggcgugcagcaaggcaggcuaucgucacucugcaagcagccucaccaaggaagaaauaaacaagaaaaacuacaaaacacaccucgacgaaauuaaaagaaacucccuacgcaacccgaucguggagaaaauccuaaaccaaauggugaacguagucaacucagucauagacaccuacagcaauauagacgaaauccgcaucgaaauggcccgcgaacuaaagaaaagcaaacccgaaagagaagauaugaguuucgcgauaucuaaagcaacaaaagagaccgagagaaucaaaggcauccuugaacaggaguucaaaauccaacacgucacgcgaaacgauaucauaagauacaggcuauaugaagaacucaaaccgaacggauacaaaacguuguacagcaauaccuacaucccacgagaagaccucuucucgaaaaaguucgacaucgagcacauaauaccaaaagccagacuauucgacgauagcuacuccaacaaaacccucgaacuccgcgacauuaacaucgagaagggaaaccaaaccgccuacgacuuuguccugucaaaauauggcgaagaaggccuguacaaauaugaacagagagucgaagaguucaagaagaacaaugagcaggcgggcacgaaaugccggaaacucuugaugagagaagcagacauaccaagcgacuuccuuaacagggaccuaaaugauucccaauacauagccaaaaaggcacacgaacuccuccgggagauaguccccacagucacggccacaacuggcagcaucacaaaucgcuuacgggaagacuggaaacuugugaaugucaugaaagaacucaacugggaaaaguacgauaaacuaggcuuaaccgaagaguacaaagacaaggacggaaacaccguccgccacaucaaggacuggaccaagcguaacgaucaccgacaccacgcgauggacgcccuaaccaucgcauucacgaagcccuccuucauccaauaccucaacaacuuaaacgccagauccaaccggggcggaagcauuuacgggaucgagcagaaagaguuggagagagaaaacaacaaguuagucuucaucccgccgauagacccgaagaucuucagaaaacaagcgaaggaacaccuauccaacauccucaucagcauaaaggccaaaaauaaaguugugaccaaaaacgugaauaaaaccaaaucaaaaucaggcaccaaccgcaaaguacagcucacacccagaggccaacugcaccuggaaaccgucuacggcaaaaucagaaccuacaaaacggaggaaauaaaaguggggacaaaacucaccgaggaauuaaucgccaaaguggcagacaagaaaauccgcgaagcacucaugcagcgcuuauccgaguacggcggaaacauaaagaaagcguuccaaaacauaucuaaacaucccaucuggcucaauggaagccacacuaaacacguccccgagaaaguaaaaaucguauucuuugaagacgucuucaccauaagaaaggcgauaacgccagacaucaaaauagacaaggugauagacuccaaaauccgacgaauacuacaagaacgccuaaacgaguucggcggcgaagcaucgaaagcguucuccaaccucgacgaaaaccccaucugguucaaccgugacaaaggcaucgcaauaaaguccgucaaaauccgcggcaucgccaaaggaacggccauaaggguuaagaaggauauccacggaaaaacuauaauaggcaacaauggcuaccccgucgcgaacgauuacguuaacaccggcaacaaccaucacguagcaaucuuccgugacaaagacgggaaccuacaggaacacaucguuucauuuuacgaggcaaccgcacgagcaauccaaaaccugccuaucgucgacaggaacuauaacuccgaaaaggacuggaaauuccuauucagcaugaaacaaaacgaauauuuugucuuuccgaacccaaacacgggauucaaccccuccgagauaucacuaaaagaugagaaaaacuacgcccucaucucaccgaaucucuuccgcguccagaagcuaagccacuacuacuaugucuuccgccaccaccucgaaaccaaugucgacaccaacuuacaacuaaaagacauaacauggaagcggaucacagcugucaauaaccugacaggagcugucaagguccgaaucgaucaccuagggcgaaucgucgacgucggagaauacaaguga

SEQ ID NO: 6724 - RNA, 4176 nt, Artificial Sequence
  Cas9 variant
augaagaacuaccacauaggacuagacauaggcacaucaaguguaggauucgccgcccgcgacgacgacaauaaccucauacgagugaaggggaaaaacgugauaggcgcgcgucucuucuccgagggccaaacugcacaagaaaggcggauggcgcgcacgucccgucgacgguacaaccgcaggaaauggcgccucagacuacucgacgaaaucuuccaugaugaaauuauacacaaagacgccgaguucuucaaucggcuaaaacaauccuuccucagccccaaggacgaacggaagcaauacuucgggucccuccuguuuccggaaacaggcgacagcgaauacuaccacaacggcaaccaaacaauauaccaccuccgccaccgccucauuacacaagacgagaaagccgacaucagagagauuuaucuagcacugcgacacauuaucaaauaccgcggaaacuuccucgacgauacccccguaucguccuucgaagccagcgaccucaagcucgcgagcuucgucccgacgauuaacgaccuauucgagacuauugacgugaacuacgaauuuuccauggacaacaucaacgaaaucgaggacauccugcucaacaauaagcugcgaaacuccgacaaaagcaagcagcucaccgacuuacuuacagaacccaucguaaauauagacgacaaaucacuagaaaagcaguucaauaaggaaaggaccgauauauccaaggaaaucgcaaagagcgucguuggcuccaaaaugaacgucaacaaacucuuaucguucgagagcagcgaaggauccaaaaucgcguucuccuuuucugacgccuccagcgaggacaaaaugauggaacuaagcgauauccuagacgacagccguaugaacauccucaacauccugaaaguaaucuacagccgcguccgucuaaaccaaaucauacccagcggaaugggcuugucggaaucgaugguagccgccuacgacucucauaagcaacaacucaaagaccugaagacccugcuaaacgucuuacccuucaacgaacgcuacgccguaaaaaucgcauacgcagcguacaucggaaauauagacaaacaaaaauucaccaaaagcgaaaucaaagcgaucgacaaacucaaagagaaauccgccauaaugaauguacucgauuucaaaucuggccacaucacaaacgaggaacuaagcaacguaaucaaagccguaaucguagacaaauaccuuaacgacgaggacuucgaguaccacggcauagucgagaaaauaaaccaagacaucuccaacggcucguaccugcuaaaacagagaaauaaucaaaacggcaacaucccacaccagcuacaucaaauggaacucgaccagaucauagaaaaccaaucaaaguacuaucacuucuugggcgagcuuaaccccaacagcaaucgcaaccauaucgcaaaauacaagaucucggagcuaguagcuuuccgggucccauacuaugugggcccccuaauuacaccugaagaacaggagaaaacguccggcgcgucuuucgcuuggaugaaaagaaagaaagauggcgcgaucacgcccuggaacuucgaagaaaaagucgacaaagaagaaacagcgagccguuucauaaagcgccucacagucaaagauacauaccuccuuaacgaagacguccuuccugacaacucgcuucucuacgaaaaauuuaagguccucaaugaacucaacguggucaaagccaauaacaaacgacugacgguagaagaaaagcaaggcgcauucgacaaucuuuucaaaaagaugaaaacagucacagcgaagcgccucaagaacuaucucgucucaaaucacaaccacaucaacagcguagagauaaccggccuuuccgacggugauaaauucaacaauucucucucaacguacauagauuuuaagaaaauauucggcgacaaaauugacaacccuggauuacuggacgacuuugaggacaucauagagugguccaccguauucgaagaccggaaaauauucgaggaaaaagucagaaaggacaucuccuggaucuccgaaagcgagauaaaaucggucguaucgaagcgauacagcggcuggggacgccucagcaagaaacuccucaacugcaucacaaacaacgagggccgaaacauaaucgacgaacugugggaggaaucagaaacuuuuauggaagccgucucuaagcccgaaguaaaagaacagaucgacggcauaaacucagacuucauaaagaacacagacaucgaaagcguccuggccgacgcuuacaccuccccacaaaacaagaaagccauccgggaaacgcacaaacucgugaaagacauccaaaaagcaaugggcggccaagcccccgcauccauuucaaucgaguucacucggaacccccaggacaaaggacaacucacacgcucgcgccauuccgaagucucuagaaaauacaaagaaauauccaaagaaaucuccaaaacccuaaacgaugaacucaaaucuaagaaaaacucaauggacguagacaaauacuaccucuacuuuaugcaaaugggcauagaccucuacgauggaagcuccaucgacauagacgaccucaacaacuaccaaauugaccacauuaucccacagagcuuuuacaaagacgacucauuugacaaccggguccugacgcacuacuccaauaaccaaaagaaaggcaauaacacgccccucaacggccuuaacaucaacgacaaaacccgugcuauauggaaccaccuucgagaucuuggccucaucacuaagaagaaguacaauggacuuacacuaaaaggcauggaccaacucuccaaauacacuaaacacggcuucauaagacgacaacugguagaaaccucccagguuaucaaacucgucgcaaacauccuauccgacgaguucagcacugacgacacgaaaauaauagaaguuaaagcgaagaugaauagccaaauccggcagguauucaaccucuacaaaguacgagaacuuaacgacuaccaccacgcagucgacgccuaccuaaccacauucauuggcggguaccuauauaaccgcuacccgaacuuacgcaacauguucgucuacggcgacuucaagaaauucucagcugacguagacaaccucaaaaccuuuaacuuccuccaugaaauuacgaacccguccgacaaauuugaggacaggaucuucgaugaaaagagcggcgaguugauucuagaccgcaaacacgcuaucgaaacaaucaagaaaauuuaccaauauaaauacaugcuaaucacgcgagaggugucaacuaaaaacggacaacucagcgaccaaaccguauacagcgcuaagcgcauaaacaacgucaaagcgccgauaccugucaaaaaggacuucaacccagaacuauacggcuuccggacaggcaacguggaucaccacaugguaaucgugaaauaccccaagaaggacagcuacgacuacaaaguaguugggaucccacuccgauucguccagaaacucaaagaaacuaaagacaacaaggacuacgagaaccugcucaaccagaucguccaaaugaaacucaaccgaaagaagcaagacuucaucguuguaguagacaacguaauguacggacagcucauccaagacggcggucaaaaguucacacucggaucaagcacauaccguuacaacgccaagcagcuagucauagacaacggcuaccucaaauuaaucgcagaugagagauauaagaacucccucacagacgaagagaaauccaaccaauauaucacccuuuauaaugaaauccuaaaagucgucaacggacgauucgacguauucgacguuaacagcuuccgcaaaaagcucaacaacggggucgacaaauucaucaagcucaacacagucgauaaacgcauaaucaucaugaagauccucagcgggcuccacuguggcccuagcaucgugccucugaaagagcucggacuaacuacaccccuagggcaauugcagagcaccagcggcaucucccucucagaaaacacuaucaucauauaccagucgccaucaggccucuucgaacgaaagguccggcucggcgaccuauga

SEQ ID NO: 6725 - RNA, 4176 nt, Artificial Sequence
  Cas9 variant
augaagaauuaccacauuggccucgacaucggcaccucguccgucggauucgcagcccgcgacgacgauaauaaccuaauacgugucaaaggcaaaaaugugaucggagcacggcuauucucagaaggcaaaacagcgcaggaacgacgcaucucacgcaccucccgacgacguuacaaccgccgaaaguggcggcuccgucuucuagacgagauauuccaugacgccauaguucacaaagacgccgaguucuuuaacagacucaaacagagcucccuaaguccgaaggaugaacgcaaacaauauuucgguucccuucucuuucccgaagucggagacggugacuacuuccgcgacgggaaccagacaauuuaccaucuuaggcacagacuaaugacgcaggaugaaaaggcggacaucagggaagucuaccucgcacuacgccacauuaucaaauacagaggcaacuuccuugacgacacgccuguaucuucauuugaagcaucagaccucaaauuagccucuuucguccccacacucaacgaccuauucgaaaccauaaaugucaacuacgagcucucaaucgacaaugucaaccagauagagaacauacuacucaauaacaaacuccgaaacagcgacaagaguaaacaacucaccgaccuaauagcugagcccgucaccaacaucgaugacaaauccuugaagaaacaauucgacaaagagcgcaaagauauaucgaaggaaaucgccaaagcaguggucggaagcaaaaugaacguaaacaaacuccuuucguucgagaguuccgacggaucgaagauaaguuucucauucagcgacgcauccuccgaagacaaaauguuagagcucuccgacauccucgacgacucaagaaugaacauccuuaauguacuaaaagucaucuacucccgcguucgccucaaccagauaauccccuccggaaugggccucagugaaucgaugaucgcggcauaugacuuacacaaacagcagcucaaagaccuuaaaacgcuauuagacgugguacccuucaacgaaaaauacgcagugaaaaucgcauacgccgccuacauaggcaacaucgacaagcagagguucacaaaggcugagguaaaaacaauagacaagcugcgcgacaagaaguccauaacauccguccucgacuucaaguccggacacauuacaaacgaagaacuaaauaacgucaucaaagaggucauaguagauaaauaccuuaacgacgaaacauucgaguaccacgacauaguagagaaaaucaaccaggacauaagcaacggcaacuaccugcucaaacaaaggaacaaucaaaacggaaacauaccccaccagcuccaccaaauggagcucgaccaaauaauagaaaagcaauccaaguacuauccauuccucggcaaacugaacccaaacagcaaacgcagccacaucgccaaguacaaaaucucagagcuaguugcguuccgcguacccuacuacguggggccacuuaucacuccagaagaacaagagaaaacaagcggcgccaguuucgccuggaugaaacgcaaagaagacggcgccaucaccccauggaauuucgaaaagaugguagacaaagaaagcacggccucacgguucauaaaaagacucacugucaaagauaccuaccuccucaacgaagacguucugcccgacaacucucuccucuacgaaaaguucaaaguccucaacgaacucaaugucgucaaagcgaacaacaagagacugacuguggaagagaagcaaggcgcguucgacaaccucuucaagcagaugaaaacgguaacagccaagcgccugaaaaacuaucuagucagcaaccauaaccacaucaacucagucaagauaaccggacuauccgacggcgagaaguucaacaacucgcucucgguguacauagacuucaagaaaauauucggcgacaaaaucgacgacuccaaacuauucgaugacuucgagaacaucaucgaaugguccacaguauucgaagaucgggauaucuucgaagaaaagguccggaaagacaucuccuggaucucagagagcgagauaaacgccguaguguccaaacgcuauuccggauggggcagacucagcaagaaacuccuaaacggcauaacuaacgacgagggacggaacaucaucgacgaacucugggaagaaagcgaaacauucauggaagccguuagcaaacccgaggucaaagagaaaaucgaugaaauuaauagcaacuucaucaaaaacacagacaucgagagcguacuagccgacgcuuacacaagcccccaaaauaagaaagccauacgggaaacauacaaacugguaaaagauauccagaaagcgaugggcggccaagcccccuccuccaucuccauagaguuuacucgcaacccccaggauaaaggagaacucaccaggagcagacacucagaaaucgccaagaaauacaaagaacucuccaaagaaguauccaagaaacucaaugacgagcuaaaaagcaagaaaaauucgauggacguagauaaauauuaccuguacuucaugcaaaugggaauugaccucuacgauggcaccuccaucgacaucgaugaccucaacaacuaccaaauagaccacaucgucccacagagcuuuuacaaagacgauucguucgacaaccgaguccuuacacacuauagcaacaaccaaaagaaaggcaacaacacgccccuaaacggccuaaacauagacagcaacacacgagaaguuuggaaccaccucaucggacuuggccucauuacgaaacgcaaauacaacaaccucacccugaaaggcauggaccaauuguccaaauacaccaaacauggcuucauccgacgucagcuagucgagacuucucaaguaauuaagcucguggccaauauccucagcgacgaauacucgaaggacgacaccaaaauaauagaagugaaagccaaacuaaacucgcaaauucgccagguguucaaccuuuauaaaaucagggaacucaacgacuaccaccacgcccuggacgcauaccuuacuacauucauagggggcuacuuguacaacagauacccgaaccugcgcaacauguucgucuacggggacuucaagaaauucuccgcaaaaauagacaaccucgaaaccuucaauuuucuacacgacauaacaaacccaagcgauaaauucgaagacagaaucauagacgaaaaauccggagaaguaauccuggaccggcgccacgccauagagaccaucaaaaagauauaccaguacaacuacaugcugauaacccgcgaagucagcaccaaaaacggacagcucuccgaucaaaccguuuacuccgcucgacgcauaaauaaagucaacucccccauccccguaaagaaagacuccaaccccgaacuauacgguuuccgcacgggcaacguagaccaccacaugguaaucgugaaauaccucaacaaagauaaauacgauuacaagauaaucggaauaccacucagguucguccagguccuuaagaacuccaacgacaacaccgaauacaagaauauccugaacaagaucguccaauccaagcuaaagggcaaguccaccgacuuccgggucauacucgacaacgugauguacggacaacucauacaggauggaggacagaaauucacucugggguccucaaccuacaaguacaacgcuaaacagcuagucaucaacauggacgacauccgaauccuaguagauaaccgauacuuuaacucccuuuccgacgacgacgcauccggagaguucaucaaaaucuacaacgaaauccuaaaagugaucaacgcacgauucgacuuauucgacauaaacaaauuccgagaaaaacuaaacaauggaaaagaauacuucgaaaaccuaagcaucgacgagaaaaaccagguacucuuaaagaugcuaucgggccuccacugcggauccgccaacguacccauaaaagaacucggauugacaacaccccugggcaaacugcagaucccaagcggaaucguacuaagcgaagacgcuaucguaaucuaucaauccccaucaggccuuuucgaaaggaaaauaagacuuaaggacauauga

SEQ ID NO: 6726 - RNA, 4176 nt, Artificial Sequence
  Cas9 variant
augaaccucagaaacuauccgggagaauacaguaucggacuagacaugggcacagguucagucggcugguccguagucgaugagaaggguaaccuacuucauuucaaaaagaaaccaacaugggggagcagacucuucgacuccgucaugccagccucggaagcccgaguacaccgaggacaacgacgacgcuacgagagacgacgauggcgucucgacuugcuacaaggucuguucaaaaacgagaugaacaagguagaccccgaguucuuuaugagacucaaccagucacguaccauagaaggggacccgaucuucacaaagaguuucacgaaagccgacuauuacgacagauuccccaccauauaccaccugagagcuuaccucauggaaucaaacgaaccugcagaccuccgacugauauaccucgcaaugcacaacaucauaaagcaccggggcaacuuuuuacgggaagaagaaaagagcuugagugcgaaacacgcggacagcaaaaaggcaguaacccaauucguagacgcgcucaaagaaugguguuuuucacgaggguacgaguucgguaaggaccccgcaaagucaauagaaaagugucugagcgauucuaaaucaucccgaagccaacucgccucggaaaucgcaaaggcccuggccguuagcacggacgcagcagccgcggacaagaaacuggcagauaacuuagccaaagcaaugguaggccuacaaugcgaguucaaauacguauucggagaauuugacugugaauccaccaaacucgcgcugucagacgacgaaaaacuagaauuacuaagggcagcgugcccggacgauucaguagaacuacucgacgcacucugcgccguauacucagccuacgugcugcaaggccugcucagcuaugccccaggacaaaccaucucacacaauaugaucgccaaauacgaccuauacaaaaccgaccugaaaacucuccgugcauugguccgagaauacgccccgggagccuacgacgaguucuucagaggggcuacguaccacgacgcgaacccagacgacuccucgaaagacuacaguuacgccgacgcggaaggcuacaccgcguacaaccuacacaaacuauccuacgacgacuucgccaaagcaguuaagaaacuacuaggugggacggacgccgucacagaugaaagauaccuuaacaugauggaacgcuucgaaaaacagcaauuccuaagacgacugaaaacgagcgacaacggggcgauauacuaccagcuccaccuagaggaguuaaccgcgauaauuaaaaaccaaggcagauuuuacagcuuucugaaagaauacgaaggaaaauucgaaucccucguaucauuccggauaccguacuacgucgggccauuaacaagcgucaacgccgcccaggacucacacaaccacaaccgauuucaguggagcgaacguaagccgggcauggagcgagaagucaucaccccauggaacugggacaccaucauagacaaaaacaagagcgccgaaaacuucaucaugcggaugaccggagacugcaccuaccucgcaggagaaaagguucuaccaaaacaaagccuccuguacgaagaguucugcguacuaaacgagcucaacggcguccgauggagcgaugacggcgacgacuggcagcgcuucgacgcagcacaacgagagggaauaguucgcgagcuauuccacaaauaccgccgugucacguacaagaugcuagaagacuggcucguuagagaaggagacgcuaaucacccaaucguaaagggaggacagggcgaaaccgggcuggaaagcaaaauggggagcuaccucuucuucgccaagggaauauucggacugggcgaacuuuccccggccgaguacccugccauugagaaaaugauuaaauggaacacacuauucgaagaucgaagcauacuuaaagaaaagcuggaagaugaguucggcgaacgcgggaauggaauguuggacgccagccaaaucaaagcaaucugcaagaaaagauucacgggcuggggccgacucagcgaacaauuucuaacgggacucaaaguagaaucuccggccggcagagcagucucaaucauggacguacuccgagaaggaaacccgugcucagagaggaggcaaggagaaacggucgucaugauggaggcgcugagagacgaaggacucggguuccagaaaaagauagacgaacacaaccgaaacuacuacgggcaacacgguaaggaucucggggucaacgaacuccccgggagcccagcuauacgccgcagucucaaccaggcaaucaggauaguagaggagauagcaagcauagccggccacgccccagcuaacaucuucaucgaagugacccgcggagaagacgcaggcaagaaaggcaaaagaacgguaaaacgcugggacaaaauaggggaagcacugaaaaagcuaaaagaagagggggucgccguagaggucauggacgacuuuaaagaacagaaagcgauaaacgccaaccuagacgaacgauuaagccuauaucuaaugcagaacggcaaaugccuauacucaggcaaagccauaaaccuagaaaaacuacuagccggaucuggcgaauacgaagucgaccacauaauaccaagagccuacaucaaagacgacuccaucgaaaauaaggcgcuaguacuaagagaggagaaccagcacaagacagaccaacugcucauagacaagucgauacgauggaaaaugagagaaacauggagccaguuacacgacgcagggcucauaggcgauaagaaguaccacaaccuccuucgaucaaacauaaaugaaaaccagcugcgagguuucaucgcuaggcagcuggucgagacuucccagauggucaaacuagcgcaagcacugcuagaagcacgcuucgcgaaugaagagacaagaauugucccagugaaagcgucaaugagccacaaccuacgggaagccgccgaccuugcaaaaugcagagaagccaaugacuuucaccaugcgcacgacgccuuccuugccuccaggauaggacucuucguccaaaugcgccacccgggaauauacgaaaaccccaucggcuacagccacgugaucaagaaauacguccaagaacaaucggagguguucaaaaagacacacaggaugccgggaagcgcgggauuuguaaucaacagcuucaugagcagcggcuucgauaaggacacuggugaaguguuuaaggacagcugggacgcagaggcagagguagacgggaucaggaaagcacuuaacuacagacaaugcuauauaucccgcaugccgcagcaagacacgggggccuucuggaacgcgacagucuauucaccccgagacccuaaaauggguccuaaacuagcccugaguacaaaacaagggcucgacccuaaacuguaugggggauucucgucccaacaguucgcguacuucuucauauacgaagcgaaaaagaaaggcaaaccgacauucagguucucgcaaguucccguaugguuggccgcgcgcaucgaggcgaacccacuggcccuagaggaauaugcccgagggcuagccaaaggagagggacuagaguucgucucaauccaacgcccgaagauauacaaaaagcaacuaauagagguaaacggcgacaaacugauaaucacgggcgcaaaggaagugagaagcggagccgaacuagcguucaaccaagacgagaucucggccauaagcauguguagcaaacuaagggccgccgaagcaggcuuggacggcgccuucagcgaagaaguguccgccaucuggaaccgcaucuccaaugcacccgugcagagcuguggacggcuccuacgacaacuaacgcuaccaaaauaucaaucgaacuucgacagcaguuccaacgaagaaaaagccgcaguaguacucggacucaucgcgcugcuaaacggcaacaaccgaauagucgaccucucaggcguaggaggaagcagccacgccggagcuaugaugaugucauacccgaaacugcuagacgacccgaaagucccauucuucaucauugaccaaagcgucaccggaauguuugagcgaaagacccgcgucggcuuauga

SEQ ID NO: 6727 - RNA, 4176 nt, Artificial Sequence
  Cas9 variant
augaagaaaauccucggcuuagaccuagggacaacgucaaucggaugggcgcucguaaaugaaaaagaaaacaaugaggagcagucuuccaucauaagacuaggaguccguguaaacccucugacaguagacgaaaaaucaaacuucgaaaagggcaaggacaucaccacuaacgcggacagaaccaagugucgcuccgcucgucgaaaccuucaaagauucaaacuccgccgcgaagccuuggcggacugccuaaagcgacacggacugaugaccgacgaaacaccccugugcgaaaccaauaacagcauaauauucaaaacuuacucaaacagggcuaaggccgucugcgagaagaucgcccucgaugacuucgucaggguauuauucaugauaaauaagaaacgcggcuacaaaagcucccgcaaauugaacaccgacgacgaagguacucucgucgacgguauggacgucgcgaaauuacuuuacaacgagcaaaucacgccaggcgaguaccucuuacgacucuucaaaaaggguaaaaagacgcgaccggauuucuacuugagcgaccugaaagccgaacuagaaagaauaugggacuuccaaagaacauuuuacccggagauccucugcgacgcgcugaaagaagaucucaagggaaaauccagaacacaguccagcgccauuuucuacgcaaaguacaagguuagcacagcaaaaaucgcgggaaaggacaaacgacuacaggaacucacauggcgaaccgacgcacuccggaagcaacuuaccauagacgaaguagccuacguaauaugcuccaucaacggagaaauaaacggcuccucacagcggcuuagcaugauauccgaccgcucaaaacuccucuauuucaaccaccaaaccaucggacaguaccuaaugcaacgacuggaagagaacccaaacgcaggccugaagaacaucaucuucuaccgucaagacuaugaagacgaauuuaacgauauauggaacucccaagccacauaccauaaagaacuaacacccgaacucaagaaggagcucaaagacaucaucuucuaccaacgcggccuaaaaagcugcaaguggcuuaucaacuacugcgagcuggagcacgaggaaaucgaagucaaaacacccgaaggcaaauuacgaaaaauaaccaucgguucaaagacuugcccaaaaucaucaccccuguuccaagaauuuaagauauggcaaguccucaacaaccugcaaguuagcccccugaacucacgacgcaaagccaaacguaagaaagacgaggaaccgagccuauucucugacgaggauaugaauacagcuugccgcuaccugaacgaagaagaaaaacuaacacucuucaaagaacucuccauaaagaaagaacuaaagaagaaagacgcacucaaacucuuguucgaaaauuacaaggagcuggaccuaaacuacaaagucauaucagggaacguaaccauggcaagccuauaccgggcguuccaagacaucaucucacucaccgggaacggagaguucgacuuccaagcgaugccagccgaagaagccgagaaaaccguagaagaaauauucggcggccuuggauacaaaacagcauuccuccacuucgacgcgucccuacacggcaaagaguucgaaagacaacccgccuaucgccuauggcaccuccucuacuccuacgccggcgaccaauccaaaaccggaaucgaagcccuggucaaacgaauacaggaacuuuguggauucgaaccagaguacgcucgcauccucgcaaacauaaguuuuauccccgacuacgggaaccuaagcagcaaagccaugagaaagauccuaccguacaugcaagacgguuacgaguacuccgaggcuugcucgaaagccggauaccggcacucggcguccagucucacaaaagaagaaaucaacaagaaaacuuacaaaacgcaccucgaugaaaucaagcgcaacagccuaagaaacccgauaguagaaaagauacugaaucaaaugguaaacguagucaacuccgugaucgacacuuacggauccauagaugaaauucgcaucgagauggcccgggaacucaagaaauccaagccugagcgugaggauaugagcuucgcaaucaacaaggcgacaaaagaaacagaacgcaucaaaggcauccucgagcaggaguucaaaauacaacauguaacacggaacgacauaauaagguaucgccuauacgaggaacucaaaccaaauggcuacaaaacacucuacagcaacacguauauuccacgagaagaccucuucuccaagaaauuugacaucgaacacaucauccccaaagcccgccuuuucgacgacuccuauucaaacaagacgcuggagcugcgggauaucaacaucgaaaagggcaaccaaaccgccuacgacuucguccucagcaaauacggagaagaaggccuauacaaguacgaacagcguguagaagaguucaagaagaacaacgaacaggcaggaaguaaaugccgcaagcuccucaugcgcgaagccgacauaccaagcgauuuccucaaucgagaccuaaacgacucccaauacaucgcaaagaaagcccacgagcuccugcgcgaaaucguaccaaccgugacagccaccacgggaucuauaaccaaccgguuacgcgaagacuggaaacuggugaacgucaugaaagagcucaacugggaaaaauaugacaaacucggccugaccgaagaauauaaggacaaggauggcaacacagucagacacauaaaggacuggacaaagcgcaaugaccaccggcaccacgccauggacgcccucacgaucgccuucacuaagccguccuuuauccaguaccugaacaaccuaaacgcccgcucgaacaaagguggaucaaucuacggaaucgaacaaaaagagcuagagagagagaacaauaagcuaguuuucaucccgcccauagaccccaaaaucuuccggaaacaggcaaaagagcacuugucgaacauccucauaagcaucaaagcgaaaaauaaaguugugaccaagaacgucaacaaaaccaaaagcaaauccggaacuaacagaaaaguucaacucacgccccgaggacaacuacaccuagagaccgucuacgggaaaauacgcaccuacaaaaccgaggaaaucaaagucggcaccaaguugacugaggaacucauagcaaaggucgccgacaagaaaauacgugaagcccuaaugcaacgcuuaucggaguauggaggcaacauuaagaaagcauuccaaaauaucagcaaacacccaaucuggcuaaauucgagccauacaaaacauguccccgagaaaguaaaaauuguguucuucgaggacguauuuaccauacguaaagccauaacaccagacauaaaaauagacaaagucaucaacagcaaaauccgcaacauccuccaggagcgacucaacgaauuugguggagaagcugccaaagcauucucaaaccucgaucagaacccaaucugguucaacaaagauaaaggcauagcgaucaaaucagucaaaauuagaggcauagcgaauggaaccgcaauccgcgugaagaaagacauccacggcaacaccaucauuggcaacaacggauacccaaucccaaacgacuacgucaacaccgguaacaaccaccacguagcaaucuuccgagacagagacgggaacuuacaagaacacauagugucguucuaugaagcaaccgcacgugccauccaaaaccucccaauuguagaccgaaacuacaacagugagaaagacugggaguuccucuucucaaugaaacaaaacgaauacuucguauucccaaaccccaacacgggguucaacccgcucgaaauagaccugcgaaacgaagaaaacuacgcccucaucuccccaaacuuauuccgcgugcaaaaauuaucacauuacuacuauguauuucgacaucaccucgaaacaaacgucgacaccaaccugcagcucaaagacauaacauggaaacguaucaaagcaauuaacaaccugaccggaguaguaaaaguccgcauugaccaucuaggucgcaucguagacgucggagaauacaaauga

SEQ ID NO: 6728 - RNA, 4176 nt, Artificial Sequence
  Cas9 variant
augaagaagaggaucgacgacuacauccugggucucgacaucggcaccaacucaugcggcugggcagucaccgacaagaaaaauaaccucuuaaaacugcgcggcaaaacagcaauuggcucacaccuauucgaagaaggccacaccgcagcggacaggcgaggcuuucguacaaccagacgccgccucaaacgacggaaauggcgccugcgacugcucgaagagauauucgcagagcccauggccgagguugacccaggcuucuucguacgauugcaccaguccuggguauccccucucgacaaaagccgaaagaaauaccaggcaauugucuucccaaccgccaaagaagaccaagaauacuaccagaaguaccccaccaucuaccaccucagagacgcacucaugacccaagaccgccaauucgacuuacgcgagaucuuuuuagccauccaccacauuguaaaauaccgagguaacuucuugcaagacacagcggucaaggacuucgaagcgucaaagaucgaagugggccccaucuuaaccaacaucaacaacgccuucgccgacaaaauaguagaaggucaggaccuuauugaacucaacgucgccaacgcagcugaaaucgaggcuguaaucagaggaaaggacgcugacaaaacccuauacaaaauggacaaggugaagaaaauagcaaaacuauugaccgacagcaccgcuaaagagcagaaaaacgucgccaagcaaauagcaaacgccaucaugggcuacaagacccaacucgagaccauccucggaaaagaaaucgacaaaaacgacaaagcacaaugggaguucaaacuuucagacgccgacgacaagcuagaugcgcuucuacccgaucuagacgaauccgaccaaaccguugucgcagaaauagagaagcuguucuccgcgaucacguugucgaccaucguagacgaaaacaagucacucagccaaucaaugguugagaaauacaacaaacaccaccaagacuacaaacuacugaaagcauacaucgaaagccugccugacagagcacaagcgaaaaagcuacuacucgccuacgaccuauacgucaacaaucgccacggucaccuacuagaagccaaaacggaguucaaacaggacuccacccucacaaaagaagacuucuauaagaccgugaaagacaaccuagacgacuccgaacuagcacacaaaauagcgcaagaaauugccgccgacaauuucaugcccaagcaacgcacgaacagcaacggcguaauacccuuccaacuccaccaaaucgagcucgacaaaaucaucgccaaucagucgaaauacuaccccuuccuagccgcggaaaauccugucgaggaccaccgcaaacaagcccccuacaaacuagacgaacugguuagguucagagugcccuacuacgucgggccaaugauaaccgccgacgagcaagagaaaaccagcggaaaauccuuugcguggaugguuagaaaagaacagggacaaauuaccccauggaacuuugaacagaaggucgaccgccaggaaucagccaacaaguucaucaagcgcaugaccaucaaagacacauaccuacuaggagaagacguacucccagcaaacucccugcuauaccaacgcuucgaaguucucaacgaacucaacaacauccgugucaacggcucacggaucucagucgaccucaaacaacaaaucuuuaaugacuuguucgaagaaaagaaaaccgucaccgaaaaagcauuaauauccuacuugaaacagaaccuucaccuccccacugucgaaaucaagggccuggccgaccccaccaaguucaauucgagccuggcaucauacuaucaccucaaaaaccuacacguauucgacaaagaacuagcggacccgcaguaccagaaagaguuugagaaaaucaucgaauacucgaguauuuucgaagacaagaagaucuuccaagacaagcuccacgcggaguucaaauggcucacccccgcccaauucaaggcaauaucuaccuggcgauuacaaggauggggccgacuaucccgcaaauuacuggucgagcuacacgacacuaacggccaaaacaucaucgaacaacucugggacagccagaaaaacuucaugcaaauagugacggaacccgacuucaaagaagccaucgccaaagaaaaccaaaauaucacacaagaaaacggcguugaagagauccucgccgacgcauacaccucuccugcaaauaagaaagccauacgccaggucguuaaagucgucgccgacguugucaaagcagccuccgggaaagccccagcacaauucgcgaucgaguuuaccagagacccggacaagaacccucaacuaucacauauacgaggcaccaaacuucugaaggcuuaccaagaaaccgccggagaacuugucgaccagaaccucaccaauagccuaaaagaggcaaugacgucacgcaaauugcugaaagacaaguacuuccuauacuucaugcaaacaggacgagacgcuuauacagggaagaaaaucaacauugaugagguauccacaaacuaccaaauagaccacauacuuccucagagcuucaucaaagacgacuccuucgacaaccgaguucucacagcaacgccacugaacgcugagaaaagcgaugaugugccuuacaaaagauucgcgaacaacuacguuucggaccuuaaaaugacaguaggagaaauguggaagcacuggcagaaagccggaaucauaaacaagcacaaacucggcaacuuacugcuugaccccgaccggcucucuaaauuccaaaaaucuggcuucauaaaccgacagcucguggaaacaucgcaaaucgucaagcuagucuccguaaucuuacaaaacaaguaccccgacgccgaaaucaucaccguaaaagccggagacaacucagcacuccgccagcgccucgaccuguacaaaucccgcgacgugaacgacuaccaucacgcuaucgacgccuaccuauccauagucugcggcaacuuccuguaccaggucuauccuaaguaccgccccuacuucgucuacggccaguuuaagaaauucucacaggacccagaccuccagaaggaccuaaucaagcacuuuaaaggcuucaccuucauguggccccuacuccaaaaggauaacuccgaacgcaaggcccuagaagaaaucaaagaaaauaacuccgauagaaucgucuucuacaaacacccagacaucuucgacaaacugagaaaagccuauaauuacaaguacaugcucguaucgcgugaaaccagcacugaaucuucuuccauguucaauaugacuauauacccccgaggugaacgagaccgcaagaaaacucgcaaacucauaccgaaaggcaacggacuagacccaaaaauuuacggcggguacagcgggaacaccgacgccuacaugguuaucguuaaaauagaaaaagccaaggaaucaaucuacaaggucaucggcauacccaugcgcgcccuagcaggacucaaacaagccaaaaaccaaggcaacuacaaggaagaacugcacaaggucguugagccccaaaucaugcuggauaaaaacgggaagccgaaacgggguguggaaggauuucgaguugucaaagaccacguacccuucaaacaaguaguccuagacggagacaagaaauucaugcucuacagcgccaaauacgaaaccaacgcgaagcaacucacacucagccaagagacuaugcggaucguaacagacaaccugaagaaauccgaggaccaggacaaacuccuaguaaaagccuaugaugagauccuccaaaaagucgaccaauaccuuccacuuuucgacgucaacaaauuccgaaacucucugcaccuaggccgcgcgaaauuccucgaccucgcagucaacgauaagaaaauuacccuuagcaacauauuaaacggacugcacgacaaccucgucguccccaaccuuaaaaacauagguauaaagacgccguucggucuaaugcagagucccucugggaucacacuaucaagcaacgccauacucaucuuucagaguccaacggggcuauucgagaaacgcguacgcauagcggaccuauga

SEQ ID NO: 6729 - RNA, 4176 nt, Artificial Sequence
  Cas9 variant
auggaaaacaagcaauacuacauagggcuggaugugggaacgaacagcgugggcugggccgucaccgacacauccuauaaucuccuacgcgccaagggaaaggacauguggggagcacgccucuucgacgaagcaaagaccgcugucgagcggagaaccaaacguaccucacgaagaagguccgagcgagaaaaagcccgcaaagcgaugcucaaagaacuuuuugcggacgaaauaaacaagguggaccccaacuucuucauccgacuggaggagaguaaguucuuccucgacgacaggucagaaaauaaccggcaacgauacacacucuucaacgacgcaaaauucaccgacaaagacuacuacgagaaguacaaaacgaucuuccaccuccguucggcgcugauaaacucggacgaaaaguucgacguaagacucguauuccuagcgauacuaaaucuguucagccaucgaggccacuuccuaaacgcaucacugaagggcgacggagaaauucagggcguggacauauucuacaacgaccuauacgaagugugcgaggaguucgagaucgaucucccacagaucaguaacauugacaacuuugaaaagauacuaagccaaaaaggaaagagccgcacuaagauccuagaggaacuaucggaggagcugagcaucuccaagaaagagaaaauaaaauacagucuacugaaacucauaugcggcaugaaaaucaaagucgucgauaucuacgcggacgaagacauacaggaagacgauaagaagaaagaccugggcuuuagagagagugauuacgagaaaagcagucuagagguaaaagagaucaucggagacgaccacuuugagcuaaucgaacgugcgaaagcgguccacgacaucggccugcuggccaacaucaucgguaacucaaaguaccucugcgaagcucgggucgaagccuaugacaaccaccacaaagaccuacagaaaaucaaagagcuccucaagaaguacgacaucaaagccuauacggacauguucagaaaaaugacggacaaaaauuacuccgcuuacguaggauccgugaacagcaacauagcaaaagaaaggcguagcguggauaaucggaaaaucgaagauuuguacgaguacauaaagaagaucgcccugaaaaacauaagcgacgacaacgaagacaaaaucgaaauccugaagaaaauagaaaccggagaguuccugaaaaagcaacuaacagccucgaacggcgugaucccaaaccaacuccaaagcagggaacuacgggcaauccucaaaaaggcagaaaauuaccuccccuuccugaaggagaagggggaaaagaaccucaccgucagcgaaaugauaauacagcuauuugaauuucaaauacccuauuacgugggcccccuagauaaaaaccccaagaaggacaagaaugccaacagcugggccguaauaccgagcggugggcggauccuacccuggaacuucgaagauaaggucgaugugaaaggcucccgcaaagaguucaucgagaagaugguaaggaaaugcacauaccuaagcgaggaacacacgcuucccaagcagucucuacuauacgaaaaguucaugguacuaaacgaaaucaauaacaucaaaaucgacggcgagaagauaagcgucgaggcaaaacaaaagauauacaacgacuuauucaugaaggggaaaaagguaagucaaaaggccaucaagcaggaacuaaucucacugaacaucaugagcaaagacagcguacuaucaggaauagacacggugugcaacgccuaccuuaguagcaucgccaaguucagagguguauucgaugaaaacguaaacaaccaaucaacaaucgacaugaucgaagacauaaucuuccugaaaacaguguacagcgacgagaagcgauucgugaaagaagagaucguugaaaaguacggcgacgagaucgacaaagacaaaauaaaacgcauccugggguucaaauucagcaauuggggaaacauaucaaagagcuuccucgagcuagaaggagcggacgucggcacaggcgaaauccgaagcauaauccaaagccuaugggagacaaacuuuaaucuaauggaacuucuguccuccagauucaccuacauggaugaacuggaaaaacgcgugaagaaacucgagaaaccccuauccgaguggacgaucgaagaccucgacgacauguauuuaaguagccccgucaagaggaugauauggcagucgaugaaaaucguugacgagauccagacaguaauaggauacgcaccgaaaaggaucuucgucgaaaugacccgcucggagggagaaaaaguacgcacaaaaucacgcaaagaccgacugaaagaacuguacagugccauaaaagaagacaguaaacaauggguaaaagagcuggacgcgaaggacgagucauacuuucgcagcaaaaagauguaccucuacuaccugcagaaagggcgcugcauguauucaggugagguuauagaacucgacaagcuaauggacgacaaccuguacgacauagaccacaucuacccgcgcagcuucgucaaggacgacagccucgauaaccucguacuugucaagaaagagaucaacaaccggaaacaaaaugaccccaucacaccccagauccaggcauccugccaaggauucuggaaaguccuacacgaacaaggauuuauaagcaacgaaaaauauagcaggcugacccgcaaaacccaggaguuuagcgacgaggaaaaauugagcuuuauaaaccgccagaucgucgagacgggacaggccaccaagugcauggcgcaaauacuccaaaaaucgaugggggaagacguugacguagucuucuccaaagcgcgucuagucucagaguuccgacacaaauucgaacuauuuaaaucccgccucauaaacgauuuccaccacgccaacgacgcguaccuuaacauagucgucggcaacagcuacuucguaaaguuuacccgcaaccccgcaaacuucauaaaagacgcacgcaaaaaucccgacaacccggcauacaaguaccacauggaccgauucuucgaacgagacguaaagagcaaaucagagguggcauggaucggucagucggagggcaacgccggaacgaucgcaaucguaaagaaaaccaugagcaaaaauagcccgcugauaaccaaaaagguagaggaagggcacgggucaaucaccaaagaaaccaucgucggcguaaaggagauaaaauuuggccgcaacaaagucgaaaaggccgacaaaacccccaagaaagcgaaccuacaagccuaccgcccgauaaaaacguccgacgagcggcuaugcaacauuuugagauacggcggccgcaccuccaucagcauaagcggauacugccuagucgaauacguuaagaaaagaaaaacaaucagaagccuggaggcgauccccgucuaccuggggcgcaaagacagccuaagcgaagaaaaacuccuaaacuacuuccgcuacaaccuaaacgacggaggaaaagacucagucagcgacauacgguugugccugccauucaucagcaccaacucgcuugucaaaaucgacggauaccucuacuaccucggcgggaagaacgacgaccgaauccaacuauacaacgcauaccaacugaagaugaaaaaggaagaggucgaguacaucagaaagauagagaaagccgucuccaugucgaaauucgacgagaucgaccgggagaaaaacccaguucuaacggaagaaaagaacauagaacuauacaacaaaauacaagacaaguucgaaaacacaguguucucaaaacgaaugagccuaguaaaauacaacaaaaaggaccucucauucggggacuuccucaaaaacaagaaaucgaaauucgaagaaaucgaccuagaaaaacaaugcaaaguacuauacaauauaauuuucaaccuaaguaaucuaaaagagguagaccuaagcgauaucggagggagcaagaguacgggaaaaugccgaugcaagaaaaacaucacaaacuacaaagaguucaagcugauacagcagucaaucacagggcuuuacucaugcgaaaaggaccuaaugacgaucuga

SEQ ID NO: 6730 - RNA, 4176 nt, Artificial Sequence
  Cas9 variant
augaaacgcaacaacgacuacuacauaggauuagacauggguacuaacagcguaggaugggccaccaccaacccacagggcaggcuacuccguuucaacaagaaagauaugugggggucacgccuauuugaggaagcgaaaacagcggcgaagacacgcaccuuccggaccucuagaagaagguacgaccgaguccggcaacgcauagaguuccuccaagacaucuucgcgccaaucaucgcuaagaaggacuucgaguucuuuaugagacucaaagaaaguaaauuucaccucgaagauaagaaaaccgacgggaaauucgcccucuucaacgacgccgacuucacagacguagaauacuucgaccgguaccccaccaucuaccaccuccgggcagcccucaucaaaccaaaccacaucacggacccccgacugcucuauuuagcgauccaccacaucaucaagaaccgaggccacuuuuuauucgcaggaaccgacauggaauccauccgcuccuuccagauagucuacacgcaacuauccgaacaucugaaguccauuaaccuagacuucgagcucccagucgacgcccaagacaaauucgccgccauacuccuaaacgagaaacucaacaagcgcgacaaaaagaagcaacugaaagagcucuguccgcacaaagacaaaagacuugaauacgcauuuaacgccauaauagguggaaagacaaagcuaaaagacaucuuuggggucgaggaauaugacgaaggcaccaagaaagcgguugacuucgagaaagcggacuacgacgaggacaaagacgaaaucgagagcguaaucaaagagaacauccacgugcuuaacgcccucaaggccguuuacgacuggaccauacuaaccaacauacucggcgacuacgcauacauaagcgaaucacagguagcauuauacgaagcgcacaagaaagaccuccgaauccucaaaucacucaucaagaaauaugccaaaucgcaauacgcagacgccuuucgccacgaaaacgucaaaggaaacuacgccaacuacguaggaaguaccaacuacgacaacaagcaacccgucaucgacaaccccucagugacacaagaagacauaaauaaauacuuugcugauauacugcucucaaucaccccggacgaaucggaccgggagucguaccaguacauaacggaacgccuccacaagggggaggcucucccaaaguuacgaacaaaagccaacagcguauugccccaccagauacacaaaaucgagcuagagaaaauccuggccaacgcagcgaagaacuucccguuccuacaggaaaaagacuccucaggcuacacagccgcccagaaaaucgugaaaauaaugauguuucguauugaauauuacgucgggccccugaacacauaccaccacguagaccaaggcggccacgccuggauggugagaaaggcggaaggcaaaauaacaccauggaacuucgacgaaaaaguagacaaagaggcgagcgccgaaaaguucauacgcaacaugacgaacaaauguaccuaccuuauagggaaggaugucaucccaaagcaaagccuccuguacucccgcuacaaaguccucaacgaacugaacaaccuaaaaguaaauggcgccccaauauccgucgcacugaaacagaaaaucuaugaagaacuuuucaagaaacaaguaaacgucacauucaaucaacugaagacauuccuaaaaacacaaggcgaggacgcggacgaaauuauucuauccggagucgacgaggcggcacauaaauucaccaacaaccuccaaaccuaucacaaguuccgcgcgauacuacgcgacaaaaucgaguucgaaccccaacgaucgauggucgaggacaucauccgcuggaagugccucaugggcgacgacaucacuauguggaagcacaagaucgaaaaggaguacggcgaccaacuaucagaggaacagcucaaaaagaucacccgcuuaaacuucaacggcuggagccgacuaucccaagaguuccucacagacguacccgguguagauaucgagucaggagaggucuacucaggaauuauggacgcccuauggcggaccaaugagaacaucaugcaacugcucagcucccgcuucacguucgcagccgaagucaaaaagcaaaaucaaggcaccggccgaaucgagaaaaucacauacgacgaagucaugaaggacacuuaccuauccccggccguaaaaagauccgucuggcaggcaauaacccucguggaagaaauccgcaaaauccgcaaagcggaucccaagaggauauucguagaaaugacacgccagccagaugcaaagaaagaacgaaaacuaucaagacgcacucaacuccuaaacgcguaccgcgcgauaggcaacgacaucgccgaauacgaaaaagagcaugugucaacucuaauuacacaacucgaauccaagaaagacgaagacuuacguaggaagaaacucuaucuuuacuucacacaaaugggccgcugcauguacacaggagaacguauagaccugagcucccuacuacgcgacaccaacucgaacauauacgauaucgaccacauauacccccggucccuaaccaaagaugacucgcuagacaacaccguccuaugcaagaaagaaauaaaucucaagaaaggcaacaaauacauccaccggguguucaccgacaaagaacuuaagaaacaauauggcuacuggaaagcacuaaaagagaagaaacuuauaagcgagcggaaauucucucgacuaaugcgcacaacagaccuuaccgcagacgaacuugccggcuucauaagccgccaacuggucgaaaccucgcaaauggugaaagcgaccgccgacauccuugagaaaauauacccaaacgugacuauagucuacguuaaagcucggacagucuccgacuuccgccacgacuacgagcucccaaaaguccgcgcccucaacgauugccaccacgcacacgacgccuaccucaacauaguggucgguaacguauacuacgaaaaguucacaaagucacccuuccgcuucaucgcgaaucaaaaggguaaaggcgauaucaaguacaaccucuaccggcuauucgacaaggacguaaagguaggcgacaggaucaucuggaacgcaaaggaggaccucgcacggguaaaggcaacacuagagcgagacaccguuaacguagugcgcaugccggucgagcagcggggccaauuuuucgacgcaaccauacagaaaaagggaacgaccaaaaacaugcugguucuaccccucaaaggcucagacgaacgucuccaagacacauccaaauacgguuacuauguacgcccaucgggaaugaguuucauggucguccaacacgaagucaagggcaaaucaagagucacaaucgagccggcacuccuaguauacaaaaacaaacucaaaagcgaagacgacuacgccaaauacugcgaagaugugcuaaaacuacagaaaccaaagguccuauucaaaaacaucaaauucggcucaaagauacuuuucgauggguacccauuccugcucaaaggaagaacggagaacagaauaaucauggcagaugcacagucucucuuccuuggcaaccaagaacucaaaauccuaaaacgcguaaccaaaaucuccgacgacauagaccacaaaguagaaagccguaucaaaaucaccgacgaagaauggaccacacucuggaaauccguaguagaacaaauagucacugguaaauuccgcaaccgacuaggcacacugaacggcauucuccagggacgcaaaaucaaacuauccaaagacgaggaagcacgacuaaacgaauuagauaguaaagaccaagagacguuccuaucucaaauucuccuggagagauuccuacaguucagcaccgaagagaaaacccggcuacuccuacaagucauauccuucaguggcaacacaaccgggguagaucuccgacuaauagggggaucuuccggcacagggacaaucaaaacaaacaaaaacauuaccgaucacucugucauacucaucaacgaaagccccacugggcuguucaccaaccggacaguauugaaccaacccuga

SEQ ID NO: 6731 - RNA, 4176 nt, Artificial Sequence
  Cas9 variant
augaaacguaacaaugauuacuacaucggccucgacaugggcaccaacagcguaggaugggccacaacaaacccccagggccgacuccuccgauuuaacaagaaagacauguggggcucccgcuuguuugaagaagcuaaaaccgccgcuaaaacccgcacauuccgcaccagccgacgucgcuacgaccgcguacgacagcgaaucgaguuccugcaagacauauucgcaccaauaauagcaaagaaagauuucgaguucuucaugcgccucaaagaaucaaaauuccaccucgaagacaagaaaaccgacggaaaauucgcacuauucaacgacgcggacuucaccgacguugaauacuucgacagauaucccaccauuuaccaccuccgagcggcacuaaucaaaccaaaccacaucaccgauccccgauuacuauauuuggcaauacaccacauuaucaagaaccgcgggcacuuccuauucgcagggacagacauggaaucgauccgaucauuccaaaucgucuacacacaacuuagcgaacaccuaaaaucaaucaaccucgacuucgaacucccagucgacgcccaggacaaauucgccgccauccuccucaacgaaaaacuaaacaagagagacaagaagaaacaauugaaagaauuaugcccccacaaagacaaaagacuagaguacgcguucaaugccaucaucggugggaaaaccaagcuaaaggacaucuucggggucgaagaauacgacgaaggcaccaagaaagcgguagacuuugaaaaagcagacuacgacgaagacaaagacgaaauagaaucaguaaucaaagagaacauccacguacugaacgcacuuaaggccguuuaugacuggaccauucugacgaacauacuaggcgauuacgccuacaucagugagagucaaguggcgcucuacgaagcccacaagaaagaccucaggauucuuaaaucgcucauuaaaaaguacgcgaaaucgcaguacgcagacgcauuucgccaugaaaauguaaaaggaaauuacgccaacuacguaggaagcacuaacuaugacaauaaacaaccgguuaucgacaacccaagcgugacucaggaagauaucaacaaauacuucgcagacauacuccuaagcaucacacccgaugaaagcgaucgcgaaagcuaucaauacauaacagagcgccuacacaagggagaagcacuacccaaacuaaggacgaaagccaauuccguccuaccccaccagauccacaagaucgagcucgaaaagauccuggccaacgccgcaaagaacuucccauuccuacaagagaaagacagcagcggcuacaccgcggcacagaaaauuguaaaaaucaugauguuucgaaucgaauacuaugugggcccuuuaaacacauaccaccacguagaccaaggaggccaugcuuggauggucaggaaagcagaaggcaaaaucaccccuuggaacuucgacgaaaaggucgacaaagaagcgucagccgagaaauucauccgcaauaugaccaacaagugcaccuaccucaucggcaaagacgucaucccgaaacaaucgcuccuauauagcagauacaaaguccucaacgaacucaacaaccugaaagugaacggggucccaaucagcgucgcacugaagcagaaaaucuacgaggaacuauucaagaaacagguuaacguaacguucaaccaacuuaaaaccuuccuaaaaacccaaggcgaggacgcggacgaaaucaucuuaucgggcgucgacgaggccgcccacaaguucaccaacaaccuccagaccuaccacaaauuucgagcgauacucagagacaagaucgaguucgaaccgcaacgaucgauggucgaagacaucauccgcuggaaaugccucaugggagacgacauaacaauguggaaacacaaaaucgagaaagaauacggugaccagcucuccgaggaacaacuaaagaaaaucacccggcuuaacuucaacggcuggucccgacuuagccaggaguuucugacugacgucccuggugucgauauagagucaggcgaaguauacucgggaauaauggacgcacuauggcggaccaaugagaacaucaugcaacuacucagcucucgauucacauucgcggcagagguaaagaaacaaaaccaaggaaccggacggauugagaaaauaaccuacgaugaagucaugaaagacaccuaccuaagcccagccguaaagcggucgguguggcaagcaauaacccuagucgaagaaauccgaaaaauacgaaaagcagacccaaaacgcaucuucgucgagaugacgcgacagcccgaugcgaagaaagaacgcaaacugucacggagaacccagcuacucaaugcguaucgagccauaggcaacgacauagccgaauaugaaaaagaacauguauccacccuuauuacucaacuggaaagcaagaaagacgaggaccucaggagaaagaaauuguaccucuauuucacgcaaauggggaggugcauguacaccggagaaagaauagacuuguccagccucuuacgugacacaaacagcaacaucuacgacaucgaccacaucuacccccggagucuuacaaaagacgacucgcuggacaauaccguccucugcaagaaagagaucaaucucaagaaaggcaacaaauacauccaccgcguauuuaccgacaaagaacuuaagaaacaauauggguacuggaaagcucugaaagagaagaaacuaaucagugagagaaaauucagccgccucaugcgcacaacugacuuaaccgcggacgaacucgccggguucaucagccgacagcuaguagaaaccagccaaauggugaaagccacagcagacauccuagagaaaauauaccccaaugucaccaucgucuacgucaaagcccggaccguuagcgacuuccgacacgacuacgaacugccaaaaguccgggcacucaaugacugccaccacgcccacgacgccuacuuaaacauaguuguggggaacgucuacuacgaaaaauucacaaaaagccccuucagauucauagcaaaccagaagggaaagggcgacaucaaauacaaccuauaccgacuguucgacaaagacgugaaagugggcgaccgaaucaucuggaacgcgaaggaagaccuagcgagaguaaaagcgacauuggaaagggauacggucaacgugguccgcaugcccgucgaacaacgugggcaguucuuugacgccacgauccagaagaaagggaccaccaaaaacaugcuagugcugcccuugaaaggcucggacgagcgccuacaggacaccuccaaauacggcuacuacguccgccccuccggcaugagcuucauggucguccaacacgaagugaaaggaaagagcagggugacuauagagcccgcccuacucgucuacaaaaauaaauuaaaaucagaagacgacuacgcgaaauacugcgaggacguccuaaagcuacaaaaaccaaaaguccuauucaagaacauaaaauucgggucgaaaauccuauucgacggguaccccuuccuacugaaagggcgcacggagaaccggaucauuauggcagacgcacaaagccuguuccucggcaaccaagaacucaaaauccugaaacgggucacuaagaucucagacgauauagaccauaaaguagaaagccgcauaaaaaucaccgacgaggaguggacgacacuguggaaauccguggucgaacagauagucacaggcaaguucagaaaccgccuaggaacccucaacggcaucuuacaggguagaaagaucaaacuauccaaggacgaagaggccagacucaacgaacuggacagcaaagaccaagaaacguuccucucccaaauccuacuagaacgauuccugcaguucagcacagaagaaaagacccgucugcuacuccaaguaauaucauucucgggcaacaccaccggcgucgaccuccgauugaucggaggcucaaguggaaccggcaccaucaagaccaacaagaacaucacagaccacucuguaauucucauuaacgagucuccgaccggccucuucacgaaucgcaccguccuaaaccagccauga

SEQ ID NO: 6732 - RNA, 4179 nt, Artificial Sequence
  Cas9 variant
augaaaagcauauuaggguuggaucuuggaacaaccuccaucggcugggcgcuagucaaagaauccgaaaacgacaacgagaaaagugaaaucguaaaacucggcguaaggcuaguuccccugacgacggacgaacgaacugacuucgaaaaaggaaaaagcauaacgacgaacgcagaccgaacaagcaaacgcucaaugcgacgcaaccuucaaagauacaaacuaagaagggaagcgcuaguaagugaacucaagaaagaacauuggauagacgaaggcuacagguucagugaagacggaccuggaagcacauucuccacgcuccgacuacgagcaaaagcagcagaagaagaaaucagccuccaggaccuagcaaaagugcuccuccagauaaacaaaaagcgaggcuacaaauccucacgcaaacuaaacagcgcagaggacggacaagccauagacggcaugagcguagccaagguccuguacgaccgcggccuaaccccaggcgaguaugucuaccaaaggauguuagacggccaguacgcgauccccgaguucuacaaaucugaccuccaggcugaguucgacaagauauggaaccuacagaaaaguuacuaccccgaacucaccgcagaacuauaugacaaacucacggacaagaacaaaucccaaacaugggccaucugccgcgacgaacuaggcguccaaggcuucaagagcuccuucacgggaaaagaacggcucaaagaagcauacuucaaccgccagcaagccucgaagcaaaaaguggaccuagagguacucacaugcgugcuucaagacaucaauggacaaaaagcaagccuaagcgggcuacuaagcgcaauaagcgaccgguccaaagaacuuuacuuuaaccgcaugaccgucggacaaaugcuaguaagacaaauccaggaagaccccaaccggucucugcgcaacaccguguuuuaccgccaagauuauauagacgaauuugaaaagaucugguccguccaaucgagguuccauccugagcuaacccaagaacgaaagaagaaacugaaagacauaauaauauucuaccaaaggccgcucaaaagucaaaaaggacucauaagccuuugcgaguuugaaagccgcgaaguggauauaucagucgacgggguaauaaagaaaaagaaaauaggcccucgcguaugcccccgaucaucaccccucuuccaagaguucaaagucuaccaaacaguuaacaacauccuggucaacggagaaccguuagacgacaacgaccgggagaaacugguaggagaacuugcguucagagagaaaaugaaaggacaagauguacuaaaacuccucuacaagacaagcaagggaaugaggauaaacuucgaagaaguggagggaaaucgaacaauggcaacgauacucaaagcaugcgagaaaauagucgaaggacucggauacgacacccgcgaucucuccaagaucacggcaucagaaaaggugagccguauagaagaaauauucgccaaggaagguuucaaaucagacuuccuacacuucgacucaagccucccaucacccgaguucgaaucgcaggcaagcuacucccuauggcaccuacuauacuccuacgaaaacgacaaaagcgucucagguaacgaaagccucgucgagaaaaucaagaaguuaugcucaauggacgaggccagcgccaaaauacuuagcggcugcacauuccucagugauuacggcucccugucagcccgagcgaugcgcaaaauccugccauacaugaaagacgggcuggaauauucagcagcaugugccauggcaggauacaggcacagcaagcgaucacucacaaaagaggaacucgacagccgaguuuacguagaccgccuugaauugcugcccaaaaacucgcuacggaaccccguaguagagaaaauccucaaccaaaugaucaacgucguaaacagcguaguggauacauacggaaagccagacgagaucaggaucgaaauggcgcgagaguuaaagaaaucggccagcgagcgagaaaaagcacaaaaagacauagcagccgccagcaaggucaaugaaagcauaguagccacacugaaggggagcccauucuucauagacagucccagcagaaaugacauaaucagguaccggcuaugggaggaacucaagccaaauggauacaaaacacuguacagcggcacguacauuccgaaagaaagacuauucuccaaagauuucgacauugaacauaucauaccgcaagcccuccuguucgacgacaguuucgcgaacaagaccaucgaaagcaggcaaugcaacauagaaaaauccaaccggaccgccauggauuacguaaaaagcaaguacgacagcuucggcguccaagcauacauagaccgaguaaaggggcuaacgggcgugagcaaaacaaaaaucaccaggcuccuaauggagucgaaagauaucccugaggauuucauaaaccgggaacuaagagacagccaauacauagcuagaaaagcacgagaaauacuagaaagcaugguaaaauucgucguaccuacaacgggaagcguuaccgcgcgauugcgggaagacuggcaacucgugaaugucaugcgagaacugaacugggacaaauacgagaaacucggacugacaucauuccgcgaggaucgcgacggacgggaaauaccuguuaucgaggacuggacgaaacguaacgaccaccgucaccacgccauggacgcacucaccauagccuucacgaggaggcaauucauacaguaccuaaaccaucuaaaugcgaaaauugacaccgucgauaagaccgacauagaccuccgggacuacaaccuggaggacauauccuucgacggccucagagacggggacaaguucgggauaguaaaggcacugcagaaaaaguaccucuacaaggacgacaaacaaaaauaccgguucguaccaccgaugccacucgacgaguuccgcauagaagcaaaacgccagaucgaagacgugcuggugaguuucaaagcuaaaaacaaaguguguacgaaaaacgucaacaccaccaaaguccgcggaggccaacagcgcaaaauacaauugacacccagaggcccccuccaugaagacaccauauacggcaaacgacugcaauacguaacaaaagaagaaaaaguagggggcagcuucgacgaagccaaaauagccucagucugcaaaaagagcuaucgcgaagcucucaugagacgucucauggaaugcgggggagaccccaagaaggccuuuacaggcaaaaauagccuagagaaaaacccugucuggguagaugaguuccacucaggagaagucccucuacgagugaggaccgucuccauggcaagcguguauacaguacguaaaagcguaggccaaucacucaauaucgagaaaguacuugacaaacacaucaaggaaauccugagagcucgccucgaggaguauggcggaaaugcgucgaaagcguucucuaaccuagacgaaaacccgaucuggcucaacaaggaaaaaggaaucgcgguuaaaagagucacaaucgacucaggcaaaaacccaaucccacuccgcuccaaguuggacaaggacggacaaaucaucuacggcgaaggccaaaauccccaggagagcgacuucguggugcccggcggaaaccaccaugcagccaucuaccggacaccuagcggcaagcuacaagacguggucgugagcuucuaugaggcaguaucacgaaagaaccugggucuagaaguaauagacaggaauuuuaagaaagacgaaggcugggaguucuuauucacacucaaacaaaacgaauacuucgucuucccgaaccccgcaacaggcuucucccccgaggacuacgaucuaaccgacccagccaacaacgccaucaucucacccaauuuauaccgcguacagacagugucaguaggggacuaccgguuccgucaccaccuagaaacuacggucgaagacaacgaaaaauuacgcgacauagccuggaaacgcauuggacccucaggccuugucggugccguaaaaguacguauagauaaccuaggccgcauccuagccgugggcgaguacgauuga

SEQ ID NO: 6733 - RNA, 4179 nt, Artificial Sequence
  Cas9 variant
auggaaaacaagaacuacucaauaggccuagacauugggacaaacagcgucggcugggccgucaucacagacgacuacaaagucccgagcaagaaaaugaaagucuuuggcaacacagacaaacacuucauaaagaaaaaccucaucggcgcgcuacucuucgacgaaggagccacagcagaagaccgccgacucaaacgcacggcccgaaggcgcuacacccgcagaaagaaccgguuaagauaccuacaggaaaucuucuccgaagagauuucaaagcucgacucaucauucuuccaccgacuagacgacucauuucucguacccaaagacaaacgaggcucgaaguacccaaucuuugcuacccucgaagaggagaaggaauaccacaagaaauuuccaacgauauaucaucugcgaaaacaccuggccgacagcaaagaaaagacggaccucagguuaauauaucucgccuuggcccacaugaucaaauaccgaggccacuucuuauacgaggaguccuuugacauaaagaacaacgacauucagaaaauauucaacgaguucauaucaaucuaugacaauaccuucgaaggaagcagccugagcggucaaaacgcacagguggaagcgaucuucaccgacaaaauauccaagagcgcaaaaagagaacggguccugaagcuguucucagacgaaaaguccacgucccucuucuccgaguuccuaaaacuaauaguugguaaccaagcagacuuuaaaaagcacuuugaccucgaagaaaaagcaccacuucaauucuccaaagacaccuacgacgaagaucuagaaaaccuucugggacaaaucggggacggauucaccgaccuauucuugguagcaaagaaacuguacgacgccauacugcuaucgggaauccuaaccgucacagaucccucaaccaaggccccauuauccgccaguaugauugaacgauaugaaagccaccaaaaagaucuagccgcacugaagcaauucaucaaaaacaaccucccgaaacguuacaacgaagucuucagcgaccaaucaaaagacggcuacgcuggauauauagacggaaagaccacgcaagaagcauucuacaaauacaucaaaaaucuacuaagcaaauucgaaggggcagacuacuuccucgauaaaaucgagcgcgaagacuuccuccggaaacaacgcaccuuugacaacggguccaucccccaccaaauacaucuccaggaaaugaacgcaauacugcgccgacagggcgaacauuacccguuccucaaagaaaaccgugagaaaaucgagaaaauccugaccuuccggauccccuacuaugucgggccccucgcccggggaaaccgcgacuucgcguggcucacacggaacucugaccaagcgauccgacccuggaacuucgaagaaauaguggauaaggcuuccucggccgaagaguucauuaacaaaaugaccaacuacgaccuauaccuacccgaagaaaaaguccuaccaaaacacucacuccuguaugaaaccuuugccguguacaacgaacucacuaaagucaaauuuauagccgaaggacugcgagacuaccaauuccuagacagcgggcaaaagaaacagaucgucaaccagcuauucaaagaaaaacgcaaagucacagaaaaggacaucauccacuaccuccacaauguagacggauacgacggcaucgaacugaaagguaucgagaagcaauuuaacgccucccucagcacguaccacgaccuccuaaagauaauaaaggacaaagaguucauggaugacccaaagaaugaagaaauacucgagaauauaguccacacacugaccauuuucgaagaccgcgaaaugauuaaacaaaggcuagcccaauacgacucgaucuuugacgagaaggucaucaaagcccucaccaggaggcacuacaccggcuggggaaaacucagcgcuaaacuaauaaacggcaucugcgacaaacaaaccggcgacaccauccuagacuacuuaaucgacgacgggaaaaucaaucguaacuucaugcagcuuauaaacgacgauggcuuaucauucaaagagaucauucaaaaagcccagguugucggcaaaacagacgaugucaaacagguaguacaagaacugccgggauccccagcgauuaagaaaggaauccuccaauccauaaaaauuguagacgaauuggucaaaguaaugggcuacgcaccagaaagcauagugaucgagauggcgcgggagaaccaaacgacagcucgcggcaagaaaaacagccagcaacgguacaagcguauagaagacucacucaaaaaccucgcccccggucuagacuccaacauccuuaaagaaaacccgacagacaacauccaacuacaaaacgaccgacuuuuccucuacuaccuucagaacggcaaggacauguacacgggcaaaccacuggacaucgaccaguugaguuccuacgauauagaccacauaaucccccaggcguucaucaaagacgacuccauagacaaccgaguacucaccuccuccaaggacaaccgcggcaaaagcgacaaugucccaucccuggaagucgugcagaaacgcaaagccuucuggcaacaacuacuugacagcaagcuaaucagcgaacgaaaguuuaacaaccucacaaaagcagagagaggcggccuagacgaacgagacaaggucggguucauacgacgucagcugguagaaacccgacaaauaaccaagcacguagcacaaauucuagacgccaguuuuaacacagaggucaacgaaaagaaucagaagauccgcacggucaagaucauaacacucaaaucuaaccuugugucaaauuuucgcaaggaguucgaacucuauaaaguccgugaaaucaaugacuaucaccacgcccacgacgccuaccugaacgccguaguagccaaggcgauccucaagaaauacccgaaacucgagcccgaguucgucuauggcgacuaccagaaauacgaccuuaaacgcuacaucucgcgcuucaaaccgagcaaagaaaucgaaaaagccacugaaaaauacuucuucuacaguaacuugcucaacuuuuucaaagaagaaguccacuacgccgacggaauaauugugaagcgggaaaacaucgaguacagcaaagauacuggagagaucgccuggaacaaagaaaaagacuuugccaccaucaaaaaggugcugagcuauccccaagucaacauagucaaaaagaccgagauucagacccacggacuugacagaggaaagcccaaggggcuauuuaacucaaaccccagccccaagcccagcgaggacuccaaagaaaaccuaguaccgaucaaacaggggcucgacccacgcaaauacggcggauaugccggaauaagcaacucguacgccguacucgugaaagccaucguugagaaaggagcaaagaagcaacaaaagacgauccucgaguuccaaggcaucucgauucuggacaagauaaacuucgagaacaacaaagaaaauuaccuacuaaagaaacgguacauagagauacugagcacaauaacacuccccaaauacagucucuucgaguucccagauggcacgaggcgucggcuggcauccauccuaucuacgaauaauaaaagaggagagauccacaaagguaacgaacucgugcugcccggaaaauacaccacacuucuauaccaugcgaaaaacaucaacaagaaacucgaacccgagcaccuagaauaugucgaaaaacacagaaaugacuucgcaaaauuacuagaaugcguacucaauuucaaugacaaauacgugggagcacugaaaaacggcgaacgcauccgacaggccuucacagauugggagaccgucgacaucgaaaaacuauguuucuccuucauaggcccagaaaacucaaagaacgcagggcuauucgaacuaacuucgcagggguccgcauccgacuuugaguuccugggcguaaaaaucccccgauaccgcgauuacgcgcccuccucccuacugaaagcaacacuaauccaccaauccauaaccggacuauacgaaacccggaucgaccuauccaaacucggcgaagacuga

SEQ ID NO: 6734 - RNA, 4179 nt, Artificial Sequence
  Cas9 variant
augaauaauaauaacuauagcaucgggcucgauaucggcacgaacagcgucgggugggccguaauaaccgacgacuacaagguacccagcaagaagaugaaagugcugggcaacacagacaagcauuuuaucaagaaaaaccuaaucggagcucuacucuucgacgaaggagcaacagcggaagaccgaagguucaaaagaacugcgcggcgacgguacacccggcgcaagaaccgccuccgcuaucugcaagaaaucuucuccgaagagaugucaaaggucgacucgagcuucuuccaccgccucgacgacucguuccuggucccagaggacaaaaggggcucaaaauacccgauauucgccacuuuagcggaggagaaggaguaccacaagaaguucccuaccauuuaccaccuccgcaagcaccucgccgacagcaaagaaaagacggaccugcgccucauauaccuagcacuagcccacaugaucaaauaccguggacacuuucucuacgaagaaucuuucgauauaaagaacaacgacauccagaaaauauucagcgaguucaucagcaucuacgacaauaccuucgaagggagcagccugucuggccaaaacgcccaaguagaagcgaucuucacugacaagauaagcaaaucggcaaagcgugaaagaauacuuaagcuguucgccuacgaaaagucgaccgaccuauuuuccgaguuccucaagcucauaguaggaaaccaagccgauuucaagaaacacuucgaccucgaggagaaagcaccacuacaguucagcaaagacacuuacgacgaagaucucgaaaaccuacucggccagauaggagaugacuucgccgaccuguuccuaguagccaagaaacuuuacgacgccauauuacuauccgguauccugacagugaccgacuccagcaccaaagccccucucuccgcgaguaugauagaacgauacgaaaaccaccaaaaagacuuggccgcccuaaaacaauucauccaaaacaaccuacaagaaaaauacgacgaaguauuuagcgaccaaucgaaagacggauacgcuagguacaucaacgguaaaaccacccaggaggcuuucuacaaguacaucaaaaaucuacugucuaaguucgaagguuccgacuacuuccuggacaagauagaaagagaagauuuucuacgaaaacagcguacauucgacaacgguuccaucccucaccaaauucaccuccaagaaaugaacgcaaucauccgucgccagggagaacacuauccuuuccucaaggaguacaaggagaaaaucgaaaccauccuaacguuccgcauaccguacuacguaggaccgcuagcacgggggaauagaaauuuugcauggcucacucguaacucagaccaggcuauaagaccguggaacuuugaagaaaucguagaccaagccuccagcgcagaggaguucaucaacaaaaugaccaacuacgaucuauaccuccccgaagagaaggugcuccccaaacacagccugcuauacgaaaccuucgcagucuauaacgaacuaacgaaagucaaauucauauccgaaggacuccgcgacuaucaauuccucgauucgggccaaaagaaacaaauaguuaaccagcuuuucaaagagaaacguaaaguaacggaaaaagauaucauacaauaccugcacaacgucgacggcuacgacggaauagagcuaaaaggcauugagaaacaauucaaugcgagccuguccaccuaccacgaccuccuaaagaucauaaaagacaaagaguucauggacgaucccaagaaugaggagauacucgagaacauaguacacacgcuaacuauuuucgaagacagggaaaugaucaagcaaagacuggcccaguacgcaagcaucuucgauaagaaagucauaaaagcucuaacccgccgccacuacacaggguggggaaagcucagcgccaagcugaucaacggcaucugcgacaagaaaacuggcaaaacgauacuagacuaccucaucgacgacggauacagcaaccgcaacuucaugcaacugaucaacgacgacggccugagcuucaaagacaucauccaaaaagcccaaguggucgguaaaacuaacgacgucaaacagguaguucaagaacuucccgggucacccgccaucaagaaagggauccuacaauccaucaaacuugucgacgagcuagucaaaguaaugggucaugcaccggaauccaucguuaucgaaauagcaagagaaaaccaaacaacagcgcgcggcaagaaaaacagccagcagcgcuacaaacggaucgaagacgcacucaaaaauuuagccccgggacucgacucuaacauauuaaaagaacacccaacggacaacauccaacugcaaaacgaucgacuauuccuguacuaucuucaaaacgguaaagacauguacacaggagaagcucuugacaucaaccaacucucgagcuacgacaucgaccacauagucccucaggcuuucaucaaagacgacucacucgacaauagaguacuaacaucauccaaagauaaccgcggcaaauccgacaacgucccaagccuggaaguagugcaaaagcgaaaagcauuuuggcaacaacuacuagacagcaaacucauauccgaacacaaguucaacaaccuaaccaaagccgaacgaggaggccuagacgagcgugacaaaguaggauucaucagacgccagcuagucgagacuaggcaaauuacaaaacacguagcucaaauucucgacgcacgauucaacacugaagucaacgagaaagacaaaaagaacaggaccgucaaaaucaucacccucaaaagcaaccucguaagcaauuuccguaaggaguucaaacuuuacaaagucagggagauaaacgacuaucaccacgcccacgacgcauaccuaaacgccgucgucgccaaagcaauccucaaaaaguaccccaaacucgaaccgggcuucgucuacggcgacuaccagaaguacgacauaaaacgcuacaucucccggucaaaggacccgaaagaggucgagaaagccacagaaaaauacuucuucuacuccaaccuacugaacuucuucaaggaagaaguacauuacgcggauggaacaaucguaaaacgcgaaaacaucgaguacucaaaggauaccggggagaucgcauggaacaaagaaaaggacuucgccacgaucaagaaaguacucagccucccacaggucaacauagucaagaaaaccgaaauccagacccacgggcuggaccgaggcaaacccagaggacuauuuaacucaaacccauccccaaaaccaagugaggaccgcaaagaaaaccugguaccaauuaaacagggccucgacccacgcaaauacggcggguacgcaggcaucuccaacucauacgcuguacucgucaaggccauuauugaaaagggcgccaaaaagcaacagaagacagugcucgaguuccaaggaauaagcauccuggauaaaaucaacuuugagaaaaacaaggaaaacuaccuguuagaaaagggauacauaaagauccuaucgaccauuacccucccgaaguauucccuguucgaguucccagauggaacucggagacggcucgcaucaauacuuagcacgaacaacaagcgcggcgaaauccacaaaggcaacgaauuggugauacccgaaaaguacaccacccugcuguaccacgccaagaacauaaacaaaacucuagaacccgaacaccucgaauacguggaaaaacaccgcaacgacuucgccaaacuucucgaauauguccucaacuucaacgauaaauacguuggagcccucaaaaacggagaacguauaaggcaagcauucaucgacugggaaacagucgauaucgagaaacucugcuucuccuucauuggcccccgcaacagcaaaaacgccggccuguucgagcugacaagccaaggauccgcuucggacuuugaguuccucggagugaaaauaccaagauaccgagauuacaccccgagcucauugcucaacgcaacgcuaauccaccagagcaucaccggacucuacgaaacgcggaucgaccugucaaaacugggagaagacuga

SEQ ID NO: 6735 - RNA, 4179 nt, Artificial Sequence
  Cas9 variant
augaaaaauuaccacaucggccuggacaucgggacgucaagugugggauucgcagcucgcgacgacgaaaacaaccuuauacgcgucaaagguaaaaacgugaucggagcucgccuguucgcugagggaaaaaccgcacaggaaaggcgcauggcgcguaccucaaggcgacgauauaaccgucgaaaauggcgccuccgccuccuaaacgauaucuuucacgacgaaaucgugcacaaagacaaagacuucuuuaaccgacuaaaacagucuucaauaucccccaaagacgacagaaagaaauacuucggaucgcuccuuuuuccugagcuaagcgauuccgaguucuaccacaacgggaaucaaaccaucuaucaccuccgccaccgacucaugacauccaacgaaaaagccgacauacgagagaucuaccucgcccucagacauauagucaaauaccgcggcaauuuccucgacgauacuccugugucuagcuucgaggcuucugaccucaaacucgggucguucauaccuacccuaaacgaccucuucgaaaccaucgacgugaacuacgucuuuaacucagaaaacaccaaccaaaucgaaagcauccuacucaauaacgaccuccgcaacucggacaaaucaaaacagcugguggaccuccuguaccgcaacgugagcgacguagacgacaaaucccuagaaaaacaauucaauaaauuccguaaggacaucagcaaagaaauagccaaauccuucguuggaagcaaauucaacguaaacaagcuauuagccuacgagaccgacgacggaucuaagaucucccucagcuucucugacgcuuccucggacgacaaaaugcucgagcuagcagacaaccuagacgacgaacgcauuaacauacucaacgcccucaagguaaucuacucgaggguccgacucaaccaaauaaucccaaacggcaugggccucuccgaauccaugauagcgagcuaugaacuacacaaaaagcaacugaacgaucuaaagaaacuccuaaacguacuacccuuccacgagaaauacgccgucaaagucgcguacgccgccuacaucggcaacauggaugcccaaaaauucacucaggcagaacugucaacaauagagagccucaaagagaaggacuccaucaagaaagucaucgauugcaaaaccggacauaucaccaacgagucucugauauccguuaucaaccaaaucgucgugaaccccuaccucgaaaacagcgacuucgaacuaaucgacaucgucaagaaaaucgaucaggacaucaaaaacggggaauaccuccucaaacaacgcaacaaccaaaacggcaacaucccccaccaacuacaucaaauggaaauggaccaaauaaucgaaaaacaaucgaaauacuaucccuuccuuggcgaacucaauccgaaugagaacaggcgccauaucgcuaaauacaaaauaagcgaacucguggccuuccggguaccguauuauguggguccccuuaucacccccgaggagcaagccaaaaccuccggcgcgagcuucgccuggaugaagcgaaaagaagauggcgagaucacacccuggaacuucgaccaaaaaguggacagagaagcuacagcgagccgcuuuauaaagcgccugaccgucaaggacacuuaucuauucaacgaggacguccucccugacaauagccuuuuauaucagcaguucaaaguccuaaacgaacucaacgucguaaaaguaaacaacaagcgccuaagccaagcugagaaacaaggggcuuuuaacgaccuauucaaagugaccaaaacagucaccgcgaaacgccuuaaaaacuaucuuguauccaacuucaaccaccuagacacuaucgaaaucacaggucucuccgacggagaaaaauucaacaacggccucaccuccuacguagauuuccagaaaauauucggcgacaaaauaaacaaccucgaacuaauggacgauuucgagucucucaucgaauggagcacggucuucgaagaucgccauaucuucgaagaaaaagugcgcaacgaaauaaacuggaucagcgagucggagcucaagcaacucguagcgaaacgauauuccgguuggggcagacucuccuccaaacuccucgucggcauuaacaacgacgaaggccgcaacauaaucgagcaacuauucgagacguccgaaacauucauggaggcaaucucccgccccgaggugaagaaacaaaucgaugagauuaacucugacuucaucaaaaacacugacauagaaucaguucuggcagacgcauacaccucgccccaaaauaagaaagccauccgcgagaccuacaaaaucgucaaggacauccaaaaagcuaugggcggcaaggcucccgaauccaucuccaucgaguucacccgaaacccggaagacaagggcgaacuaacccgcucccggcauuccgaaaucucaagaaaauacaaggaacugagcaaggaaauuucgaaggaauuaaacgacgagcucaaaagcaagaagaacucuauggacaucgacaaguacuaucucuacuucaugcaaaugggaaaagaucucuacgacggcaaauccauagacaucgacgaucuaaauaacuaccaaaucgaccacauagucccgcagagcuucuacaaggacgacuccuuugacaaccgaguacuaaccuacuacacgaacaaccaaaagaagggcaacaacacaccccucaauggacuuaacaucagcaaugaaacgcgaaaacuguggucccaccuccacgacuuaggccuaauauccaaacgaaaguaccucaaccuaacgaugcaaggcuuagacagccuauccaaauauacuaaacacgguuuuauccgucgacaacuugucgaaaccucccaaguaaucaagcucgucgccaacauccugucggacgaauuuuccgcggacaacacaaaaaucauagaagucaaggccaaaaugaacagccagaugcggcacuccuuuaaccuguauaagauccgcgaacucaacgauuaucaccacgcauuagacgccuaucucaccacauucaucggcggcuaccucuacaaccgauacccgaaacuccgggguauguucguauacggggauuucaagaaauucgaugucaacgaugccaacaacguaaaaacccuaaacuuccuucacgacauaaccaacccuucagauaaauuuguaaaccagauuuacgaugaacaauccggagagcuuauccucgaccgcaaacacgccauugaaacaauaaagaaaauauaccaauacaaauucaugcuaauaacucgggaggucucgaccaaagacgacaagcucuccgaccaaacgguauauuccgcaaagcguaucaauaacgucgcgucaccgauccccgugaagaaagacuccaacccagagcuauauggauuuagaaccggcaauguggaccaccacauggugaucgugaaauaucccaagaaagacagcuuuguauacaaaguggucgggauucccaucagauucaugcaggaacuacgaucaucgaaaaaccaaucagaauacgaaaauacgcuaaaucaaaucguccaggccaaacuuaacaggaaaaaguucgacuuccgcgucgucgucgauaacguuauguacgggcaauuaauccaagacggcggccaaaaguucacucucggcuccuccaccuaccgcuacaacgccaaacaacucguacucgacauggacagccugcggauacucucagacgaaaaguaccguaacucccuaacagaugaugagaaaaauuccgaguucaucaacaucuaccaacaagucuuaaacgucgucaacgaaaaauuugacguuuuugacguccgcggcacccgagacaagcucaccaaaggccuggacaaauuccuuaacaucacaucaaacgacaaggaaauuguccuccucaaaauucuuucaggacuacacugcaaugccgcccggguuaagauaaacgaaauagguaucaacacuagcuucggcgagcuccagaccacccacggcauaguacuuagcgaaaacuccuacauaauauaucagagcccaucgggacuuuuugagcgaaagguacgacucaaagaccuguga

SEQ ID NO: 6736 - RNA, 4179 nt, Artificial Sequence
  Cas9 variant
auggccaacaaaacgugguaccuaggucucgacaucggaucggccagcguaggcugggccgccacagacaccggcuauaaaauaauacggaaaaauaaaaagcgccucuggggcguccgccuauucgaagaagccaagaccgcagaagaccgcaggggauaucgcuccagccgccggcgacucgcccgaagaaaauggaggcugaaccuccucgaggaacucuucacgucggaagugaagaaaguugacgaaaauuucuuccugcggcucaaagaaagccaguaccacuaugaagauaaaacucacaaaguccccuacgccaucuucaacgauaaagauuacaccgauaaagacuacuacaaggacuaccccaccaucuaccaccuacgaagcaaacucaugaccgaggaaaaccccgacauucgcaaaguguuccuggcaauccaccacaucaucaaaaaccgcgggcacuuccuucuccaaggccaaucguucaaagacggcaacuuaaacaaccucauaaaggagcuacuagagcucgacauacuacauguaggauucgaggugacggaagaagucgucgacaaaaucgcagacaucucacuggagaagaagaccucaaaggacaaacuaaacgacauaaaagaacuauacccuaaagagaaacaauuacucgaggucuuccgccucauuuucggcggaaagacaucgcuggacaagcuauucgcgauagacgaauacaaggagcuagacgcagcaauaaagucugucuccuucaaagagaaaaucuacgaagagguccgccacgacuaugaacaggugcucuccaacuacauagaacuacuggaccucgcaaaacucguauacgauuccauaauccuguccgacauaaagaaagaagggaaaacacucagcgaauccaaaguggaauuauucgaaaaacaccgagacgaccuccuaaagcucaagaaccuaguaaagaacgauagcaagcucagcgaggacaaaaaggucgaguuauacgcccucaucuucaaagaagacaaagacaaggggacgaacuaugucaacuacauacgcaagucagaggagggcaaaggcugcaacuacgaagauuucaagaaauuccuaguaaaagaacuagcgaaacuggaagaauccucugucaaaacggaaauaaucaaagaccuggagcuagaacaguuccucccacuucaacggacaaaggacaacucagugguuccauaccaaauccacaaagaggaacuugugaagauccuggauaacgcagcgcgauaucacagcuuccucaaugaaaaagacgagagcggauacaacgucagagagaaagucauccagcuacuggaguuccgcauaccauacuaugucggcccccuaaacuccagcaaaaaggcaaaagaaggaggauucgcaugguccguucggaacaccgguuaugagaacacccccguuacccccuggaacuacuccaaaguaauugacgaaucagccuccgcagaaaaauucauuacgaaccucaccaacaaaugcacauaccucaaaggagaagacguacuccccaagucgaguuuacucuauagcgaguucgcacuccuaaacgaacuaaacgcccucaaguacgacgguaaccgcaucagccuggaagcccgaaacacuauaaucgaaaaacuguucaagcaacaaggcaagaaagucaccaaaacaucuaucaaaaaccuacucaaagcugaaggcuauauagacggaaagggcgaaauaacgggcauagauauuacagugaagaacgaccugaagucauaccgcgacuuuaagaaaauacucggaaacaaauucaauagcgaacacgucgaaaauauaauccucuggaucacucuauacggcgaaucgcgaaaacuaauaaaagccaagauagagucggucuauggcgaagucuacucgaaagacgaaauaacaaagaugucccgccuaguauauaaggacugggguagguucuccagaaagcugcugacagagcuaguaagcaagaaacuuuacaacgaagaaacuggagaaugccuaaacauuaucggcgccaugcgccaaaauaacauacuauucauggaacuacucgcagaccgauucgacuacagcaaacaaaucguggaguucaacaaagaacuucaagaagacgucacagaaaucgccccggagauccucgacgaccucuacguaagcccagcgguaaaaagaucgaucuggcagacaguccgaaucguggaagaacuaaagaaaauaaucggaugcgcgcccgccaaaaucuucguugaaaccacccgcucgaaccaagagaagaagaaaccaacagacucgcggaagaaacaacucgagcucgccuacaaagcggucaaaaaggacgucaaggagcuagaaaaagaaaucgggacgaucaacuucgacguacugaacgaucggcucagcuccguagagcccagcaaguugaaggcaaagaagcuguaccuauacuauacacaacuugggaggugcauguacuccgaggaaccaauaaacauuucggagcuguuugacaacaauaaauacgacaucgaccacaucuacccacaaaguaagaucaaagacgacagcuucacgaauacggugcuagugaaaagggagucaaacgcugccaagacugaccgguacccccuaggcuccgacauccaaacucccagcaacagaagauucuggaaauuccuaaaagagaaaggacuaauuuccgaugagaaguacaaccgccucgugcggaccgaagaguucagcgaugaagaacuaagcggcuucauagcgcgccaacuugucgagacuagccaauccgucaaagccguagccucaauccuaggagagcucaacccagagaccuccauaugcuacagcaaagcagagaacgucagcagcuuccgccagaacuucggaaagaucaagaagggggaccgagacucuaaaaacaacgaccaacucaucaaagucagagaaauaaaugacuaccaucacgcuaaagacgccuacuuaaacgucguuguggggaacguauacgauacaaaauucaccaggaauguuuucaacuucauaaaggacaagaaggacggccgcaaguacucgcuuaacaagguauucuacgaaaacgucagcgacagcaagaccguagccugggagauggauaagacgauacaccaagucgagaaggucaugaacaauaacaacauaauggucacccgccgcacgucagagcaaaaaggcggucucuucgacgccacaguuuacaaagcuaaaguugcagcaaaagccaaagacggaguguacuaccccuuaaaaacgagcaacucggugguaaaggacgucgccaaguacgguggcuacaccagcaucggcauugcauauuacagcaucuucgaauacacgaucguuaacaagaagggcgaagagaaaaucacgagaauaaucccaauaccgaucuauauaagccagaacauuaaggacagcacagcacugauagaguucgguaagucacagaucuucugccgugccuacgagaaaaucaaagacuuuaaacugcuguaccggaaacuaugcaucggcagcaaaauuaacauaaacaacuaccaguacuacaucggcgguaagagcgacgaacgauucuacuacgacucagccauacaaguaacacucgacaagaaaagcgaaaaauaccucaagauccuaucgaaauaccaaaauuggaagaaagaaaacaaagacggcgaacucugggaaaacaucacaaaagaaaacaacaucgaacuuuauaauaaacugguagagaaaaugaacuccgaaauuuucacgaaaaagaagaguaacaaauauaacgaacucaacucggaggaaauacgaaacaauuucaucaaaauaucggucgaggaacaagcgaaaguacuccuugaaauacucaaccuccuaacaaacaaaaagagcaucuuugaccuaaaguccauagacauaaaagcagcacgcggcaagaucagcuuuaacuugaccucauuaauccaguucagcaucaucgaacaaucaauaacaggauucuacgaaaaagagaucacgauaauaggagauaaaggcaacgauauggaaaacaacaacagcuga

SEQ ID NO: 6737 - RNA, 4179 nt, Artificial Sequence
  Cas9 variant
augaacaauaacaacuacagcauaggccucgacauaggcacgaacuccgucgggugggcaguaaucaccgacgacuacaaggucccaagcaagaaaaugaaaguccucggaaauaccgacaaacacuucauuaagaaaaaccucauuggcgcccuccuguucgacgagggaacaacagccgaggaccgccgacuaaaaagaaccgccagacgcagguauacacgaaggaaaaaccgccuucgguaucuacaagagaucuucucgcccgaaauuuccaaggucgacagcuccuucuuccaucgccuagaugacuccuuccuaguaccugaagacaaacgcggaucuaaauaccccauuuucgcaacccuagcugaagaaaaagaauaccacaaaaacuuucccaccaucuaccaucugcgcaagcaacucgcugacucaaaggaaaaggccgaccuccgacuuauauaccucgcacuagcucacaugauaaaauaccgcggccacuuucuauacgaagaaucguucgacaucaaaaacaacgacauccagaaaauuuucaacgaguucaucaguauuuacgacaacaccuuugaaggcagcucacuuuccggccaaaaugcgcaaguggaagcaaucuucaccgauaaaauaagcaaguccgcaaagagagaaagaguccuaaagcuauuccccgacgaaaagagcacgggguuauucagugaguucuugaaacucauagucggcaaccaagccgaguucaaaaagcauuucgaccuagaagaaaaagccccacuucaauucuccaaggacaccuacgacgacgacuuggaaaaccuucucgggcagaucggagacggcuucgccgagcuauucgucgccgccaaaaagcuauacgaugccaucuuacuuagcggaauccucaccguuacagacccgucgaccaaagcaccacuuucagccaguaugauagagcgcuacgaaaaucaccaaaaagaccucgcggcgcuuaaacaauucauccaaaacaaccuucaagaaaaauacgacgagguuuucagcgaccaauccaaagacggauacgcaggcuacaucaacggcaagacgacgcaggaagccuucuacaaguacaucaaaaaccuccuuaguaaauucgagggauccgacuacuuccuggacaaaauagagcgugaagauuuccuaaagaaacagcgcacuuuugacaacggcuccauaccacaccaaauccaccuccaagaaaugaacgccaucauucgucgccagggcgagcacuaccccuuccuucaggaaaacaaagagaaaaucaagaaaauccucacguuucgaauaccguacuacgucggcccgcucgcgcgcggcaacggcgacuuugccuggcucacucgaaauuccgaccaagccauccgaccguggaacuucgaggagaucguugaccaggcaucgucagccgaggauuucaucaacaaaaugacaaacuacgaucuauaucuccccgaggaaaaaguccuaccuaaacauucccugcucuacgaaacauuugcagucuacaacgaauuaaccaagguaaaauucauagccgaagggcuucgcgacuaccaauuccucgacuccgggcaaaagaaacaaaucgucaaccaacuguucaaagagaaaagaaaagucacagaaaaagacauuacucaauaucuacacaacgucgacggcuacgaugguaucgaacugaaggggauagaaaaacaauucaacgcaucgcuauccaccuaccacgaccugcugaaaaucaucaaagacaaagcauucauggacgaugcagaaaacgaagccacacucgagaacaucauucacacacucaccaucuucgaggacagagaaaugaucaagcaaaggcucgcccaauaugacucacuguucgacgaaaaagucauuaaagcccucaucagaagacacuacacaggcugggggaagcuaucagccaaacuuauaaacggaauaugcgacaagaaaaccggaaaaaccauacucgacuaccugauagacgacggcuacaguaaccgcaauuucaugcagcugaucaacgacgaugggcucucauucaaagacaucauucagaaagcgcaaguggucggccgcaccaacgacgucaaacagauaguccaugaacuccccggauccccagcaaucaaaaagggcauacuccaguccaucaaaauagucgaugaacucguaaaaaucaugggccacacccccgaauccauagugauagaaauggcgcgcgagaaccagaccaccgcccgaggcaagaaaaauagccaacagagguacaaacgaaucgaagaugcgcugaaaaaccuugcgccaggccuugacuccaacauucugaaagaguaccccacggacaacauccagcuccaaaacgaccgacucuuccucuacuaccuacaaaacggaaaagacauguacacaggcgaaccccuugauaucaaccaacugucuaguuacgacaucgaucacaucgucccccaagccuucauuaaagacgacucacuggacaaccgagugcucacaagcuccaaggacaaccggggcaaguccgacaacgucccaucacuggaaguaguacaaaagcguaaagccuucuggcagcaacuacuagacucaaagcuaauuucggaacgaaaauuuaacaaccuaaccaaagcggaaagggguggccucgacgagcgcgacaaaguaggauucaucaggcgccagcucgucgaaacgagacaaauaaccaaacacguagcacagauccucgacgccagguucaacacggaagucaccgaaaaagauaagaaaaacagaaaugucaaaaucauaacgcucaaaagcaaccucgucagcaacuucaggaaagaguucaaacuguacaaaguccgagagaucaacgacuaucaccaugcccacgacgccuaccuuaaugccgugguggcaaaggccauacucaagaaauacccuaaacuagaaccagaguucguauacggagacuaucaaaaauacgaccuaaaacgcuacauuagccgcucaaaagaccccaaagaugucgaaaaagcuaccgagaaauacuucuucuauuccaaccucuuaaacuucuucaaagaagagguucacuaugccgauggaacgauaguaaaacgcgaaaacaucgaguacucaaaagauacuggcgagauagccuggaauaaagaaaaagacuucgcaacgauaaagaaagucuuaucacucccucaggucaacaucgucaagaaaaccgagauucaaacgcacggacuagaccgcggcaaaccucgcggccuauucaacaguaaccccuccccuaaacccagcgaggacagcaaagaaaaucuaguaccaauuaaacaagggcucgacccaagaaaauacggcggauacgcgggcaucaguaacuccuacgcgguccuggucaaagcaauaauagaaaaaggugcgaagaaacagcagaaaaccgugcucgaguuccaaggaauauccauccuggacaaaauaaacuucgagaaaaacaaagaaaacuaccugcucgaaaaaggcuacaucaaaauacugucaacgaucacccucccuaaauacucgcuguucgaguucccagaugggacacgacgacgccuggcgagcauccuaagcacuaauaacaagcgcggcgaaauccacaaaggcaacgaguuggucaucuccgaaaaguacaccacgcuccuauaccacgccaaaaacauaaacaagacacucgaacccgagcaccucgaauacguagaaaaacacaggaaugauuucgcaaaacugcucgaaaguguguuagacuucaaugacaaguaugucggcgcccugaagaacggagaaagaauccggcaagccuucaucgauugggaaaccgucgauaucgaaaaacuaugcuucuccuucauuggcccacgcaauuccaaaaacgcuggccuauucgaacuaaccucacaagggucggcuucugacuucgaguuccucggcguaaaaaucccccgcuacagagacuacacucccuccagucugcucaacgccacgcucauccaucaauccauuacuggacuauaugaaaccaggaucgaccuauccaaacuaggcgaagacuga

SEQ ID NO: 6738 - RNA, 4179 nt, Artificial Sequence
  Cas9 variant
augaacaauaacaacuacucgauaggccucgacaucggcacaaauuccguuggcugggcagucaucacggacgacuacaaggugcccucaaagaaaaugaaaguccuaggaaacaccgacaagcacuucaucaaaaagaaucucauaggcgcccuucuguucgacgaaggcgcaaccgccgaagaccgccgguucaaacgcaccgcacgucgacgauacacaagaagaaagaaccgccuucgguaccuacaggagaucuucagcgaagaaauguccaaagucgacagcucguucuuucacaggcucgacgauucauuccuugucccagaagacaagcgaggcagcaaguacccaauauuugcuacccucgccgaggaaaaagaauaccacaagaaauuucccacaaucuaccaccuacgaaaacaccuggccgacuccaaggagaaaaccgaccugcgccuaaucuaccuagcacuugcccauaugaucaaguaccgaggacauuuccucuacgaagaaucauucgacaucaagaacaacgacauacagaaaaucuucucggaguucaucucgaucuacgacaacacguucgaaggcucaagccucucuggccaaaaugcacaaguggaagccauauucaccgauaaaaucagcaaauccgcgaagcgggaacggauccucaaacucuucgcauacgaaaaguccaccgaccuuuucuccgaauuucuaaagcuaauagucggaaaccaggccgauuucaagaagcacuucgaucuagaggaaaaggcgccgcuccaauucucuaaggauacuuacgaugaagaccucgagaaccuacucgggcagaucggagacgauuucgccgaucucuuccuagucgcgaagaaacuauacgaugccauccuacugagcggaauuuuaaccgucaccgacagcucaaccaaggcaccccucuccgcuuccaugauugaaagauaugaaaaccaccaaaaagaucuugcugcacuaaaacaguucauccagaacaaccuccaggaaaaguacgaugaagucuucagcgaccaaaguaaagacggauacgccagauacaucaacgguaaaaccacacaagaagccuucuacaaguacauuaaaaaccuucucuccaaauucgaaggcuccgacuacuuccuggacaaaauagagagggaagacuuccuccggaaacagcggaccuuugacaacgggucgaucccacaucaaauacaccuccaagaaaugaaugccaucauuagacgucaaggcgaacacuaccccuuccuaaaagaauacaaggagaagauagaaacaaucuugaccuuccgaauccccuacuacgucgggccacuagccagggguaaccgcaacuucgccuggcuaacccguaacagcgaccaggccauacgccccuggaacuucgaggaaaucgucgaccaagccuccuccgccgaggaguucaucaacaagaugacgaacuacgaccuuuaccuaccagaggaaaaaguacuccccaagcacuccuuacuauacgaaaccuuugcgguauacaacgaacucacaaaagugaaauucaucuccgaaggccuacgugauuaccaauuccuagacuccggccaaaagaaacaaaucguuaaucaacuguucaaagagaaacgaaaaguaaccgaaaaagacauaauccaguaccuccacaacguagacggauacgacgguauagaacucaaagggaucgagaaacaauucaacgcgucacuuaguaccuaccacgaccuccucaaaauaauuaaagacaaagaguucauggacgacccaaagaacgaagaaauacuagagaacaucguacacacacugaccaucuucgaagacagagaaaugauuaagcaacgguuagcccaauacgccagcaucuucgacaaaaaggucauuaaggcccuaacccgacgccacuacacuggauggggcaaacuuagcgcuaaguuaaucaacggcauaugcgacaagaaaacgggcaaaacuauacuggauuaccucauagacgacgguuauucgaacagaaacuucaugcagcucauuaaugacgauggucuauccuucaaagacaucauccagaaagcacaagugguagguaaaaccaacgacgugaaacaagucguccaagaacuaccggguucccccgccaucaaaaaggguauucuacagagcauaaagcuggucgacgagcuagucaagguuaugggacacgcccccgaaagcauagucaucgagaucgcgcgcgaaaaccagaccaccgcgcgcggcaagaaaaacucccaacaacgauacaaacgaaucgaggacgcccucaagaaccucgccccagggcuggacuccaacauucugaaagaacaccccacggauaacauucaguugcagaacgaccgacucuucuuauauuaucugcaaaacggaaaagacauguacacgggcgaagcccucgacauaaaccagcuaucauccuacgacaucgaccacaucgucccacaagcauucaucaaggaugacagccuagauaaccgcguacuaaccagcagcaaggacaaccgaggcaaaucugacaauguccccagccuugaagucguccaaaagagaaaagcauucuggcagcaacuccucgacagcaagcugauaagcgaacacaaauucaacaaccuaacuaaagcagagcgaggcggucuagacgagcgcgauaaggucggcuucauccgcagacaacuggucgaaacuaggcagaucacgaaacacguggcccaaauacuagacgcacgauucaacaccgagguaaacgaaaaagacaagaaaaaccgcaccgucaaaaucauuacgcucaaaucgaaccuggucagcaacuuucguaaagaguucaaacucuacaaaguacgcgaaaucaacgacuaccaccacgcccacgacgccuaccugaacgcggucgucgccaaggcaaucuugaagaaauaccccaaacuagagcccgaauuugucuacggggacuaccaaaaauacgacauaaaaagguacaucagccgcuccaaagacccaaaggagguugagaaagcaaccgaaaaauacuucuucuacuccaaucuccuaaacuucuucaaggaggaaguccauuaugcagacggcaccauagucaagcgcgagaacaucgaauacuccaaagacacaggagaaaucgccuggaacaaggaaaaagacuucgccaccaucaaaaagguacucucccuuccacaagucaacaucguaaagaaaacggaaauccagacccacggauuggaccggggaaagccgagaggccuauucaacuccaacccgucaccaaaaccauccgaagaccguaaggagaaccuaguaccuaucaagcaaggacuagacccgcgaaaauauggaggauacgccggcauaucaaacaguuacgcgguccucgucaaagcaaucaucgaaaaaggcgccaagaaacagcagaaaacuguacucgaguuccaaggaaucuccauauuggacaaaaucaacuuugaaaagaacaaagaaaacuaccuacucgaaaagggcuacaucaaaaucuuauccaccauaacacuccccaaauacagccucuucgaguuccccgacggcacgcggcgacggcuagccucaauacuguccacaaacaacaaaagaggagaaauucacaaaggaaacgaacuggucaucccagaaaaauacaccacccuacucuaucaugccaaaaacauuaacaaaacccuggaacccgagcaccuagaauacgucgaaaaacaccgcaacgacuucgccaaacuauuagaguacguccuuaauuuuaacgacaaauauguaggagcgcucaaaaacggugaacguauccgccaggcguucauagacugggaaacagucgacauagaaaaacuuugcuuuucuuucaucggcccccgcaacuccaaaaacgccggccuauucgaacuuacaucacaaggcucagcgagcgacuucgaguuccucggagugaagauaccgagguaccgagacuacaccccauccucccuacucaacgcaacccucauccaucagucuaucacggggcuauacgaaacccgcauagaccugucuaaacucggagaggauuga

SEQ ID NO: 6739 - RNA, 4182 nt, Artificial Sequence
  Cas9 variant
augaaacgcgugacggaagacuacauccucggccucgacauaggcaccaacagcugcggcugggccgucacggacaagaaaaacaaccugcuaaaacuccgcggaaagaccgccauugggucccauuuauucgaggagggccacaccgccgcagaccgcagagguuuccgaaccacccggcguagacuaaaacgccggaaauggagacuccgccuucuagaggaaaucuucgcggaacccauggccaaggucgacccaggcuucuucguacgccuucaccaauccuggguuucaccccuagacaaaucaaggaaaaaguaccacgccaucguguuccccaccgccaaagaagacaaagcauucuaucaaaaauaccccacaauauaucaccuaagagacgcccuuaugacacaagacagacaauucgaccuccgcgaaaucuucuuggcgauccaccacauugucaaauucagaggcaacuuccuccaagacacaccugucaaggacuucgaggcgucgaagaucgaaguaggccccauccucuccaaaaucaacggcgccuuugcggagaagaucgucgaagaccaagacccaaucgagcucaacguagcgaacgcugcagaaauagaagccguaauccgcggcaaagacgccgauaaaacccuguacaaaauggacaagguaaagaagauugccaaacuccucacugacucaacagcaaaagaggagaaaaacguagcuaaacagauagcgaacgcggucaugggguacaagacgcaauucgaaacaauacucggaaaagaaauagacaaaagcgacaaagcacaaugggaauuuaagcucaccgacggcgacgccgacgauaaacuugaagcucuccucccagaccuagacgaaaacgaccagacgaucauagcagagauaaagaaauuguuuagcgcaauuacccucagcaccaucguggacgagaacaagucgcucagccagucuaugguugccaaauacaacaagcaccaccaggacuacaaacuccucaaagcauacauagacacucugcaggacaggucgaucgcaaagaaacuucugcucgccuacgaccuuuacgugaacaaucggcacgggcgccuccucgaagccaaaacggaguucaaacaagauggaacccuuacuaaagaagacuucuacaaaaccguuaaggacaaccucgaugacuccgaguuagcccgaaagaucgcccaaaagaucgcugccgacaacuucaugcccaaacagcgcacuaacuccaacggcguaauacccuuccaacuacaccagauagaacucgacaaaaucauugcaaaccagagcaaauacuaccccuuccuggcggccgagaacccgguggaggaccaccgcaaacaggcgccguacaaacucgaugagcuaguucgauuccgggucccauauuauguaggacccaugauaacacccgacgaacaagagaaaaccagcggcaagagcuucgcuuggaugguacgcaaagaagacgggcaaaucaccccauggaacuucgaacaaaaaguagaccgacaagagagcgcuaacaaauucauaaaacgaaugaccaucaaagacacuuaccuacucggcgaagacguacucccggccaacagcuuacuuuaccaacgauucgagguccugaacgagcucaacaacauacgcauaaacggcucacgaaucagcaucgacuugaagcagcaaaucuucaacgaccuauucgaagagaagaaaacagugacagagaaaagucucacuagcuaccugaaacaaaaccuacaccucccaaccgucgaaauaaaaggccucgccgaucccacaaaauucaauuccucacuagcaucauacuaccaucugaaaucccuccacguauucgacaaggagcuugcagauccccaauaucaaaaggauuuugagaaaaucauagaauacuccuccaucuuugaagauaagaagauauaccaagauaaguugcacgccgaguucaaauggcuaacacccgaacaauucaaggccaucaguaccuggagacuacaagguuggggccgacuuucuugccggcuucuggucgaacuccacgacacaaacgggcagaacauaauggaacagcuaugggacucccagaaaaacuucaugcaaaucguaacggagccggacuucaaagacgccaucgccaaggaaaaucaaaacgugacccaagucaacggcguggaagaaauccuggcggacgccuacacaucucccgccaacaagaaagcaauucgccaagucgugaaaguuguggccgacgugguuaaagcagcaggcggcaagaagccagcgcaauucgccaucgaguucacccgcgaccccgacaaaaacccccagcucucccacauccgcggaaccaaacuauugaaagccuaccaagaaacagccggcgagcucgucgaccaaaagcucacggacagucuaaaagaggcaaugaccagucgaaaacuacugaaagacaaguacuuccucuacuuuaugcagaccggacgcgacgccuacacgggcaagaaaaucaacaucgacgaagucacgacuaacuaccagaucgaucacauauugccucagagcuucauuaaggaugacuccuucgacaacaggguucucacagccacuccgcucaacgccgaaaaauccgacgacguccccuacaaacgcuucgccaacaacuacguaucggaccuaaaaaugacuguaggcgaaauguggaaacacuggcaaaaagccggaauaauaaacaagcacaaacuggggaacuuacuacucgacccggaucgccugaacaaguuccaaaagucugguuucaucaaccgacaacuggucgaaacaucacaaauaguaaagcuaguauccguaauccugcaaaacaaauaccccgacgcugaaauaaucaccguaaaagccggugacaacagcgcacuccgccaaagacucaaccucuacaaaucccgugacguuaacgacuaccaccacgcaaucgacgccuaccucucgaucaucugcgggaacuuucuguaccaaguauacccaaaauaccguccauauuucguguacggaaaauacaagaaauucucacaggacccagaccuccagaaagaccuaauuaaacacuucaaaggcuucaccuucauguggccccuccuacagaaggauaacuccgagcgcaaggcgcccgaggaaauaaaagagaauaacagcgagcgaaucgucuucuauaaacacccggacauauucgacaaauuaagaaaggcuuacaacuacaaauacaugcuagucagccgcgagacgacaaccgaaucaagcucaauguucaagaugaccaucuucccgcgaggcgagcgcgauagaaagaaaacacggaaacucauccccaaagggaacggccuugacccaaaaauuuacggcggauacagcgguaacacagacgcguacaugguuauaguaaaaauugauaaagcaaaagaauccauauacaaaguaaucgggguaccgaugcgcgcuuugacucgacuuaaccaagcuaaaaagcaaggcaacuaccaagaggaacuccaccaaguacuagaaccucagaucaugcuagacaagaacggcaagcccaaacgaggagucaaggguuuuaggguaauaaaagaccacguacccuuuaagcaggucgugcuagacggugacaagaaguuuaugcuuuauucggcacaauacaagacuaacgccaaacagcuagccuuaagccaggaaacaaugcgcaucgucacagacaaccugaaaaagggggaagaccaagacaaacuacugguuaaagccuacgacgaaauacuacagaaagucgacugcuaccugucgcuguucgacaccagcaacuuccgcaacggacuacaccucggccggaacaaauucauagaccucgaagucaacgacaagaaaauuacacucagcaacauucuaaacggccuucacgacaauaugguacuugggaaucucaaaaacauuggaaucggaacgccacuaggccaaaugcaagaaaaaucuggcaucacccuaucaccagaagcuguacuaaucuuccagucgccaaccgggcuguucgaaaaacgcguaaaaauugccgaccucuga

SEQ ID NO: 6740 - RNA, 4188 nt, Artificial Sequence
  Cas9 variant
augaagaaagaaauaaaagacuacuuccucggccucgauguaggaaccggguccgucggcugggcaguaaccgacaccgauuacaaacuccuaaaagcgaacaggaaagacuuaugggggaugcggugcuuugagacagcagagaccgcugaggugcgacggcuacaccgaggagccaggagacgcauagaacgccggaagaaacggaucaaacuccugcaagaacuguucagccaagagauugcuaaaaucgacgaaggcuucuuccaacgcaugaaagagagcccguucuacgccgaggacaagaccauccuacaagaaaaugcacucuuuaacgacaaagacuucaccgacaaaacguaucauaaggcauaccccacgaucaaccaccucauuaaagcauggauagagaauaagguuaaacccgauccccggcugcuuuaccucgcaugucacaacaucauaaagaagcgaggccacuuccucuucgagggcgauuucgacagcgaaaaccaguucgacaccucaauccaagcccuguucgaguaccuacgagaagacauggagguggacaucgacgcagacagccagaaggugaaggagauccugaaagacucaagccuaaagaacuccgaaaaacaaagccgacucaacaagauccugggccugaagccauccgauaaacaaaagaaagcaaucacaaaccucaucucagggaacaaaaucaacuucgccgaucucuaugacaauccagaccucaaagacgcugagaaaaacuccaucagcuucuccaaagacgacuucgacgcgcucagcgacgaccucgccucgaucuuaggugacagcuucgaacuacuccucaaagcuaaagcgguauacaauuguuccguccuaucaaaggucaucggggacgagcaauaccucagcuucgccaaggucaaaauuuacgagaagcacaagaccgaccuaacgaaacuuaaggcaguaaucaaaaagcacuucccaaacaacuauaagaaaguguucgguuacaaccaggacaacgaaagcaaaaacaacuacucaggcuacgugggaguauguaaaaccaaaaacaaaaagcuaguaauaaacaacucagugaaccaagaggauuucuacaaauuccucaaaccuauacucuccgccaaauccgagaucaaagaaguaaacgacauccuggcggagauugaaaccggaaacuuccuaccgaaacaaaucuccaaaaguaaugcagaaauaccauaccaacugcgaaaaauggagcucgagaaaauccugucaaacgcagaaaaacacuucagcuuccucaaacaaaaagacgaaaagggccucagucacuccgaaaagauuaucaugcuccucacauucaaaauccccuacuacauaggaccaauaaacgauaaccacaaaaagagcuuccccgaccgguguuggguagucaagaaagaaaaaucacccuccggaaaaacaacccccuggaacuuuuucgaccacaucgauaaggagaaaaccgcagaagaguucaucaccagccguaccaacuuuugcacguaccugaucggcgaauccguccugccuaaaaacucacuccucuacagcgaauacaccguacucaacgaaaucaacaaucugcagaucaucauagauggcaagaacaucugcgauaccaaacugaagcagaaaauauaugaagaccuuuucaagaaauauaaaaagauaacccagaaacaaaucuccaccuucauaaagcacgaagggauaugcaacaaaacggacgaaguuauuauacugggcaucgacaaagaaugcaccucuagucugaaaagcuacauagagcuaaagaacaucuucgggaagcaagucgacgagauaucaacuaagaauaugcuagaagaaauaauccgaugggcaaccaucuacgacgaaggggaagggaaaacgauacuuaagacaaaaauaaaggcagaguacggcaaguauuguucagacgaacagauaaagaaaauccucaaccucaaauucaguggcuggggccgccuaucacgcaaguuucuggaaaccgucacgucugaaaugccaggcuucucggaaccaguaaacauaauuaccgcgaugagggaaacgcaaaauaacuuaauggaguuacuaucuuccgaguucaaauucacagagaacaucaagaaaaucaauagcggauucgaggacgccgaaaaacaauuuucauaugacggccucgucaagccccuguuccucuccccuagcgucaagaaaaugcucuggcagacccucaaacucguaaaagagauaagccacaucacacaagcgccacccaaaaagauuuucauagaaauggccaaaggagccgagcucgaacccgcgagaaccaagacccggcuaaagauccuacaagaccuauacuccucgugcaagaacgacgcggacgccuucagcagcgaaauccaauaucuaagcggcaaaaucgaaaacgaggauaaucuacgccugcgcucugacaaacucuaccuuuacuacacccagcucgguaaaugcauguacugcggcaagccaaucgagauaggccacguuuucgauaccuccaacuacgacaucgaucauaucuacccgcaauccaaaaucaaggacgacaguaucucaaaccguguccucguauguuccucaugcaacaaaaacaaagaggacaaauacccccugaaauccgagauccaaagcaaacaacggggcuucuggaacuuccuccaacguaacaacuuuaucucccuggaaaaacugaaucgauuaacccgaacgacaccaauuagcgacgacgaaacugcgaaguucauugcacgccaacuugucgaaacacgccaggccaccaaggucgccgcgaaaguacucgagaaaauguucccugaaaccaagaucgucuacuccaaagcagaaacagucagcauguuccgaaacaaauucgacaucauaaagugccgagaaauaaacgacuuccaccacgcccacgacgcauaccugaacaucguggucggaaacgucuacaacaccaaauucacgaacaacccguggaacuucauuaaagaaaaacgcgacaacccuaaaauagcggacaccuacaauuauuacaaaguauucgacuaugacgucaaacgaaacaacauaacagccugggaaaaagggaaaacaaucauaaccgugaaagacaugcucaaacgcaacacuccaaucuacacccgacaggccgccugcaaaaagggaggccucuucgaccaaacgauaaugaaaaaggggcucggacaacacccccucaaaaaggaaggcccguucagcaacaucucaaaauacgguggcuacaacaaaguauccgcagcauacuacacauuaaucgaauacgaagagaaagguaacaagauccguagccucgagaccaucccgcuauaucucgucaaagacauccagaaggaccaggacguccuaaaaagcuaccucacggaccuccuggggaagaaggaguucaaaauacucgugcccaagauaaagaucaauagucuacuaaagaucaacggauuucccugccacaucacagggaagacaaacgacuccuuucuccuccgccccgcuguccaauucuguugcucgaacgacgaaguacuguacuucaagaaaaucauccgauucuccgaaauaagaucccagcgcgagaaaauaggcaagacaauaucgccuuacgaagaccuuucguucagauccuacaucaaagaaaaccucugcaaaaagaccaagaaugacgaaaucggcgaaaaggaguucuacgaccuccuacaaaagaagaaccucgaaauuuaugacaugcuacugacuaaacacaaagacacgauauauaagaagcgaccgaacagcgccaccauugacauucuaguaaaaggaaaggaaaaguuuaagagccuaaucauagaaaaccaguucgaagugauucucgaaauccugaaacucuuuucggcgacacggaacgucucugagcuacagcacaucggcgggagcaaauacagcggaguggccaagaucggcaacaaaaucaguagccucgacaauugcaucuuaauauaccaaagcaucaccgguaucuucgagaaacggauagaccuccuuaaaguguga

SEQ ID NO: 6741 - RNA, 4188 nt, Artificial Sequence
  Cas9 variant
augaaaaaggaaauaaaagacuacuuccuaggccuugacgucggcacgggcucagucgguugggccguaacggauacggacuacaaacuucugaaagcgaaccguaaggaucuauggggcaugcgaugcuucgaaacggccgaaaccgcagaggucagacgccugcaccgcggggcccggcggcgaauugagcggcgcaagaaacgcaucaagcugcuacaagagcuuuucucacaggaaauugcaaaaauagacgaaggcuucuuccagcguaugaaagaaagcccguucuacgcggaggacaaaacaauacuccaggagaacacccucuucaacgacaaagacuucacggacaagacguaccacaaagccuacccgacgaucaaucaccucauaaaagccuggauagaaaauaaggucaagcccgacccccgacuccucuaccucgccugccacaauaucaucaagaaacgcggacacuuccucuucgaaggggacuucgacucagagaaccaauucgacacuucgauccaggcuuuauuugaguaucugcgggaagacauggaagucgacaucgacgcugacagccaaaaaguaaaagagauacucaaagacuccucccugaaaaacagcgaaaaacaaucccgucuuaacaaaauacuaggcuuaaagccaagcgacaaacagaaaaaggccaucacgaaccuaauaagcggcaauaaaauaaacuucgcagaccuauacgacaaccccgaccucaaggacgccgagaagaacucaaucucguucucaaaagacgacuucgaugcacucucggacgaccuagccucaauccucggagacuccuucgaacuccuccuaaaagccaaagcaguuuacaauuguuccguccuaagcaaaguuauaggcgacgaacaauaucugagcuucgcuaaagugaaaaucuaugaaaaacauaaaaccgaccucaccaaacucaaaaacguaaucaaaaagcacuuccccaaagacuacaaaaagguauucggcuacaacaaaaacgaaaagaacaacaacaacuacaguggcuacgucgguguaugcaaaaccaaguccaagaagcucauuauaaacaacucugugaaccaagaagacuucuacaaauucuuaaagaccauacuaucugccaaauccgaaaucaaagaaguuaacgauauccucacugaaaucgagacggggaccuuucucccaaagcaaaucucaaagucaaacgccgaaauccccuaccaacugcgaaaaauggaacucgagaaaauacucucgaacgccgaaaaacacuucucauuccugaaacaaaaggacgaaaaaggccuuucgcacuccgagaagaucauaaugcuccuaacauucaagaucccguacuacaucggccccauaaacgacaaccacaagaaaucuuuucccgaccguugcugggugaucaagaaagaaaaaucucccagcggcaaaaccaccccauggaacuucuucgaccacaucgacaaagacaaaacagccgaggcauucauaacaucgcgaaccaacuucugcaccuaccucgucggagaaucaguacuaccaaaguccagccuucuauacucagaauauaccguacuaaaugaaaucaacaaccuacagaucaucauagacggcaaaaacaucugcgacaucaaacuuaaacagaaaaucuaugaagaacucuucaagaaauacaagaaaauaacgcaaaaacagaucucgaccuucauaaaacacgaaggcaucugcaacaaaacagacgaggucaucauacuggggaucgacaaagaaugcaccucuucgcuaaaauccuacauagagcugaaaaacaucuucggaaaacaagucgacgaaaucucgacuaagaacauguuagaagaaaucauucgcugggccaccauauacgacgaaggcgaaggcaaaacgauccucaagaccaaaauaaaggcagaguacgguaaguacugcagcgacgagcaaaucaagaaaauccugaaccuaaaguucagcggcuggggcagacugucccgcaaguuccucgaaaccguaaccagcgagaugcccggauucucggaaccgguaaacauuauuaccgccaugcgagagacacagaauaaccuaauggaauuacuaagcagcgaguucaaauucaccgaaaacaucaagaaaauaaacagcggcuuugaagaugcagaaaaacaguucucauacaauggucucgucaaaccccucuuucucucccccuccgucaagaaaaugcuguggcaaaccuuaaaacucgucaaagaaauaucucacaucacgcaggcuccgccgaagaaaaucuucaucgaaauggcgaaaggcgccgaacucgaaccagcucgaaccaaaacucggcuuaaaauacuucaagaccuguacaacaacugcaaaaacgacgcggacgccuucaguagcgaaauaaaggaccucucuggaaaaaucgagaaugaagacaaccuaagacuacgaucagacaaacuauaccuguacuacacacagcucggcaaaugcauguacuguggcaaaccuaucgaaaucggucacguguucgacaccagcaacuacgacaucgaccacaucuauccacagaguaagaucaaggacgauuccaucuccaaccgaguccuggucugcagcagcugcaacaaaaacaaggaagacaaauaccccuuaaagagcgaaauccaaagcaagcagcgcggcuucuggaacuuccugcaacgcaauaacuucauaucucucgaaaaacucaaccgacucacccgaaccaccccaauaucggacgacgaaacggccaaauucaucgcgcggcagcucgucgaaacacgccaggcuacaaaaguagccgcuaaaguucucgagaaaauguucccagaaacuaaaaucgucuacucgaaggcagagacagucuccauguuccgcaacaaauucgacauaaucaagugucgcgagaucaacgacuuccaucacgcgcacgacgccuaccucaacauuguaguugggaacguauacaacaccaaguucacgaacaaccccuggaacuuuaucaaggaaaaacgggacaacccgaagauugccgacacguauaacuacuacaaagucuucgauuacgacgucaagcgaaacaacaucaccgcgugggagaaagguaaaacaaucaucaccgucaaggauaugcuaaagcgcaacaccccgauuuacacccgucaagccgcgugcaaaaagggcggacuguucgaucagaccauuaugaagaaaggucuuggccaacaccccuugaagaaagaaggcgcauucuccaauauaagcaaauacggagguuacaacaaggugucagcggcguacuacacuuuaauugaauacgaggaaaaaggcaacaaaauccgcucgcuagagacgauaccgcuuuaccuagucaaggacauacaaaaagaucaagacgucuuaaaauccuaccucacggaccuccucggaaagaaagagauaaagauacucgugccaaagauuaaaaucaauucucuuuugaaaaucaacggguucccaugccacaucacgggcaaaaccggcgacuccuucguccugcgccccgcgguccaguuuugcugcagcaaugacgaagugcuuuacuucaaaaagaucauccgguucaacgaaaucagaagucaacgagagaaaaugggaaaaacgaucucucccuacgaagaccuuucauuccgaagcuacaucaaagaaaaccuauguaagaaaaccaaagccgaugaaauuggcgaaaaagaguucuacgacuuacuucaaaagaaaaaccucgaaauuuacgacaugcugcucaccaagcacaaggacacaauauacaacaaaagacccaacuccacaacucugggcaugcucaccaaagggagauacgaguucaucaacuugaaaccgaaagaccaaauuaucguaaugcucgaaauccucaaacucuucugcaccacccgagaagccaucgaucucggccuaaucaaggguaagccggcagccggggucgccacccuuggaaagaaaauaucgaacccggacaacugcauccuaauauaccaguccauaacaggaaucuucgaaaagcgaauagaccugcucaaggucuga

SEQ ID NO: 6742 - RNA, 4188 nt, Artificial Sequence
  Cas9 variant
augggcgacaccgugaaaaauuaucacaucgggcuagauaucggaaccagcagcgugggcuucgccgcuagagaugacgacaacaaccucauacgagucaaagggaaaaacguaaucggcacgcgccuguucuccgaaggacagaccgcccaggaacgccgcauggcgcgcgcgucaaggcgccgcuacaaccgucgaaaauggcgucuacggcuacuagacgaaaucuuccacgacgagaucauacacaaggacgccgaguucuucaauaggcugaaacagagcagucugagccccaaagacgagcgcaaacaauacuucggaagccuccucuuccccgaaguaggcgacuccgaguauuaccacgacggcaaccagacaauauaccacuuacgacacagacucaugacccaagacgaaaaagcggauauucgcgaaaucuacuuggcacuccgccacauaaucaaauaccgcggaaacuuucuggacgacacgcccgucagcucguucgaggcguccgaccucaaauuggcguccuucgugcccacgcucaacgaucucuucgaaaccaucgacguaaacuacgaguucaguauggacaauauuaacgagauagaagauauacuacucaacaacaaacugagaaacuccgacaagagcaagcagcuacccgaccuccucacggaaccaauugugaacaucgacgauaaaucacuugagaagcaguucaacaaggaacggaccgacaucagcaaggagaucgccaagucgguagugggcagcaagaugaacgucaacaagcuccucagcuucgaaagcagcgggggauacaagaucgcguucuccuucucggacgccuccagcgaagacaagaugauggagcugucggacguccucgacgacagcagaaugaacauccucaacaucuuaaaagucauauauagccgcguucgccucaaccaaauaauacccuccgguaugggccucagcgaaucaauggucgcugccuacgaccuacacaagcaacaauuaaaggaccuaaagaaacuauugaacguccuuccguucaacgaacgauacgccguaaaaaucgcguacgcggcauacauugggaacauagacaaacagaaauucacaaaauccgaggucaaaacaaucgacaaauugaaagaaaagucggcaauaaugaacguacuagacuuuaagucaggacacaucaccaaugaggaacucucaaacgucaucaaagugguaauuguugacaaauaccuaaacgacgaaaacuucgaguaccacagcaucgucgagaaaaucaaccaagacauaucgaacggcuccuaccuacugaaacaacguaacaaccaaaacgggaacauaccacaccagcuccaccagauggaacucgaccaaaucauagaaaaccagucaaaguauuacccuuuccucggggaacuaaaccccaacucgaacagaaaccacaucgccaaauacaaaauuagcgaacucguagccuuccgcguaccauacuacgucggcccacuuauaacacccgaagaacaggaaaagacgagcggcgccagcuuugcguggaugaaacgaaaagaggacggagcgaucacacccuggaauuucgaagaaaaaguagacaaagaagaaaccgccagucgauucauaaaacgccucacagucaaagacacauaccuccuaaaugaagacgugcucccagacaauucgcugcucuacgaaaaauucaaagucuugaacgaacuaaacgucgucaaggccaauaacaagagacugacagucgaggaaaaacaaggcgccuucgacaaccucuuuaagaaaaugaaaacagucacagcuaaaaagcugaagaacuaucucguaucaaaccauaaucauaucaacucugucgaaauaacgggccucagcgacguagacaaguuuaacaacagccucagcaccuacauagacuucaaaaagauauucgacgauaaaaucgacaacccugaccuacuugaugauuucgaagacaucaucgaaugguccacaguguucgaggaccgaaaaauauucgaagaaaaaguacgaaaggacaucagcuggauaagcgagucagagaucaaggcuguaguguccaagcgauacaguggauggggccgccucuccaaaaagcuacugaacggcaucaccaacaacgagggccggaacauaaucgacgagcuuugggaagaaagcgaaaccuucauggaggcagucagcaaaccggaaguaaaagaacaaaucgacggaaucaacucggacuucauuaaaaacacagauauagaaagcguccucgcggacgcauacacgagcccccaaaacaagaaagccauccgcgaaacccacaagcuaguuaaagacauccaaaaagccaugggaggccaagcccccgcaucuaucuccauagaguucacccggaauccccaggacaaaggccaacuuacucgcucccgucacuccgaagucagucgaaaauacaaggagauaucaaaggaaguaucgaagacccuaaacgacgagcucaaauccaagaaaaauagcauggacguagacaaauacuaccucuacuucaugcaaaugggcauagaccuuuaugacggauccucaauagauauagaugaccuaaacaauuaccaaaucgaccacaucauaccacaauccuuuuacaaagacgacagcuucgauaaccguguauuaacacacuauucgaacaaccagaagaaaggcaacaacacaccacucaauggacuaaacauagaugacaaaacaagagcaaucuggaaccaccuccgcgaccucgggcucaucacaaagaagaaauacaacggccuaacgcucaaaggcauggaccagcucagcaaauacaccaaacacgguuucauccgacgccaacucguagaaacuucccaagucaucaagcuaguggcgaacauccucagcgacgaguucuccacagacgacacgaaaauaaucgaaguaaaagcaaagaugaacucacaaauccggcaagucuucaaucucuacaaaguccgagaacugaacgauuaucaccacgcaguagacgccuaccugaccacuuuuaucgguggguaccuguacaaccgcuaucccaaccugcgcaacauguucguguacggcgacuuuaagaaauucucagccgacguggacaaccuuaagacuuucaacuuccuacacgacauuacaaaccccucagacaaguucgaagaccgcaucuucgaugagaaaagcggagaauuaauccucgacaggaagcacgcaaucgagaccaucaagaaaauauaccaauacaaauauaugcugauaacacgcgaggugaguaccaaaaauggccaacugucagaccaaacaguauacagcgcaaaacgaaucaacaacgucaaagcaccaauccccgucaagaaagacucgaaucccgaacucuauggguuccggacagggaacguagaucaccacauggucaucgucaaauauccgaagaaagacaguuacgauuacaaagucgugggcaucccacuacgauucguccagaaacuuaaagagacaaaggacaauaaagacuaugaaaaccuucuuaaccaaaucguccaaaugaaacucaaccggaagaaacaggacuuuaucguagucgucgacaacgucauguacggacagcucauccaggacggaggggaaaaauacacacucgguagcagcacguacaaauacaaugccaagcagcuagucauaaauauggauaaaacgcgcauucuggaagacaacagauaccucaacuccuuagacgaaggugaagucuccgaaaaacuggucaauauauacaacgacauaaugaaggugguaaacucacgcuucgaucuauucgacauaaacaaauuccgggaaaaacuaaaugacggacucaauaaauucaaaaacaucuccaacgagcagaaagaagagacccuccugaagauacuguccggucugcacugcggcagcgcgaacguccccauaaaagagcuuggcuuaacaacgccccuaggaaaacuacagcuaccaucagggauaguccuauccgaagaagccgugguuaucuaccagucaccguccggacuauucgagaacaaagucaggcucaaggaccuauga

SEQ ID NO: 6743 - RNA, 4188 nt, Artificial Sequence
  Cas9 variant
augaagaaagaaaucaaagauuacuuccucgggcuugacguagggaccggauccgucggaugggcggucacggacacugacuacaaacuacuaaaagccaaccggaaagaccugugggggaugcgauguuuugagaccgcugaaaccgccgaaguacgccgacuccaccgaggagccagacgccgaaucgaacggcggaaaaagagaauaaaacuccuccaagaacucuucucccaagaaaucgccaaaacagacgaggguuucuuccagagaaugaaagagucacccuuuuaugccgaagacaaaaccauucuacaggaaaacacccuguucaaugacaaggacuucgcagacaaaaccuaccacaaagcauacccgaccauaaaccaccucaucaaggcguggauagaaaacaaagucaaaccagacccccgccuccucuacuuggccugccacaacaucauaaagaaacgagggcacuuccuauucgaaggggacuucgacucggagaaucaguucgacaccucaauccaggcccucuucgaauaccuccgcgaggacauggaagucgacaucgaugccgauagccagaaaguuaaagagauccucaaagacucgagccuuaaaaacuccgaaaagcagagucggcuaaacaaaauccuaggccucaagcccuccgacaagcaaaagaaagccaucaccaaccugaucucuggcaacaaaauaaacuucgcagaccuauacgauaaucccgaccucaaagacgcagagaaaaacagcaucuccuucuccaaagaugacuucgaugcccucuccgacgaccucgcaagcauccuaggcgacuccuucgaacuccugcucaaagccaaggccguauacaacugcagcgugcucucuaaggucaucggcgacgaacaauaccuaucuuuugcgaaaguaaaaaucuacgaaaagcacaaaaccgaccugaccaaacucaagaacgucaucaagaagcacuuccccaaagacuacaagaaagucuucggcuauaacaaaaacgagaaaaacaacaauaacuacaguggauacguaggagucugcaaaaccaaaagcaagaaauuaauaauaaacaacucgguuaaccaggaagauuucuauaaauuccucaagaccauccucucggccaaauccgaaaucaaggaagucaacgacauccuaacagaaaucgagaccggaacguuccugccaaaacagaucucgaagucaaacgccgaaaucccguaccagcuucgcaagauggaacucgagaaaauacucagcaacgcggaaaaacacuucagcuucuugaagcaaaaagacgagaagggacucucacacuccgaaaagaucaucaugcuccugacguucaagaucccguacuacauaggccccaucaacgacaaccauaagaaguucuuuccugaccggugcuggguggugaaaaaggaaaaaucaccaucuggaaaaaccacaccuuggaacuucuucgaccacauagauaaagaaaagaccgcagaagccuucauaacuuccagaacgaacuucugcaccuaccuagucggcgaguccguccuccccaaauccucccuccucuacagcgaguacaccguccucaaugagauuaauaaccuccagauaauaaucgacgggaagaacaucugcgacaucaagcuaaaacaaaagauauacgaagaccuauucaagaaauacaagaaaauaacgcagaaacaaaucucaaccuucauuaaacacgaggggauauguaauaaaaccgacgaggucauaauucuaggaauagacaaagaaugcacuucaagccuaaagucauacauagaacucaagaacaucuucggcaagcaaguggacgagaucucuaccaagaacaugcucgaagaaauaauucgcugggccaccaucuacgacgagggggaaggaaaaacgauucuaaagaccaaaauuaaggccgaguauggaaaauauugcagcgacgagcaaaucaagaaaauacucaaccugaaauucucuggguggggacgacuaucccgcaaauuccucgaaacaguaaccucggagaugccgggcuucucugaaccgguaaacauaaucaccgcaaugcgcgaaacucaaaacaaccuuauggaacuccucagcagcgaguucaccuucacagaaaacauuaagaaaauaaacagcggauucgaagacgcagaaaaacaauucagcuacgacggucuagucaaaccccucuuccuaagcccuucagucaagaaaaugcucuggcaaacccugaaacucguaaaggaaaucagccacaucacccaagcacccccgaagaaaauuuuuauugaaauggccaaaggagccgaacuagaacccgcacgaacaaaaacgcgucucaaaauccugcaggaccuauacaauaacuguaaaaacgacgcagaugcuuucuccagcgaaaucaaagaucuuaguggcaaaaucgaaaacgaagacaaccuccgccugcgaucagacaagcuauaccuauacuauacccagcugggaaaaugcauguacugcggcaaaccaauugaaauagggcacgucuucgacaccucgaacuaugacaucgaccacauauacccccaaucaaaaauaaaagacgacaguauuucuaaucgaguccuagucugcucgucaugcaacaaaaacaaagaggacaaguauccccucaagucagagauacaguccaaacagcgcggcuucuggaacuuccugcagcgcaacaacuucaucucacuugaaaaacugaaccgauuaacccgggccacgccgaucagcgacgaugaaacagcgaaguucaucgcacgacaacuuguugaaacccgccaagcgaccaaaguggccgcgaaaguacucgagaagauguuucccgaaaccaaaaucgucuacucuaaggccgaaacaguaaguauguuucgcaacaaauucgacauagucaagugccgcgaaauuaacgacuuucaccacgcccacgacgcauauuugaacaucgucguagguaacgucuacaauaccaaauuuacgaacaaucccuggaacuucauuaaagagaagcgcgauaauccaaaaaucgcagacacguacaauuacuacaaaguguucgacuaugacgugaagaggaacaacauaaccgccugggagaaaggcaaaaccauuaucaccguaaaggacaugcuaaagaggaacacgcccauuuacacucgccaagccgcgugcaagaaaggcgaacucuucaaccagacgauaaugaagaaaggacuaggacaacauccgcucaagaaagaaggcccauucuccaacaucagcaaauacggcggauacaacaaagugucagcagcguauuacacccugauagaauaugaagaaaaaggcaacaaaauacggagccuggagacaauaccccucuaccuagugaaagacauccaaaaagaccaggauguccucaaaucuuaucugacggaccugcucggcaaaaaggaguucaaaauacuugucccuaaaaucaaaauaaauucccuccuuaagauaaacggcuuucccugucacaucaccggaaagaccaacgacagcuuccuacugcggccugcaguccaauucugcugcucgaauaacgaagugcuauacuucaagaaaaucaucagauucucagaaauacggucccagcgcgagaaaaucggaaaaaccaucuccccauacgaagaccucucauuccguagcuacaucaaggagaaccuauggaaaaagacuaaaaacgacgaaaucggugagaaagaguucuacgaccuccuccaaaagaaaaaccuagagauuuacgacauguugcuaaccaaacacaaagacacaaucuacaaaaagcggccgaauagcgccacaaucgacauccuaguaaagggcaaggaaaaguucaagagccugaucaucgaaaaccaguucgaagugauccuggagauccuaaaacuauucagcgccacccggaacguuuccgaccuacaacacauaggugguucaaaauacucaggaguagcaaaaaucggaaacaaaaucuccucccuagacaacugcauccucaucuaucaaaguauaacaggcaucuucgagaagaggaucgaccuucucaaggucuga

SEQ ID NO: 6744 - RNA, 4188 nt, Artificial Sequence
  Cas9 variant
augaacgccaaccgagaaauggcguacuacaucgguauagauaugggcaccgguuccgucggaauggcuauaacggacgagaauuauaaccugcucaaaguaaaaggucaagacuacugguuuguacgagaguucgagaccgcaaacacgcagauaaaacgccgaaugcauagaauaucaaaaaggcgacucaggcgccaccaaguacgcguggcccucauacgaagcuacuuugcggaagaaauccucaaaaacgacccgcucuuuuucauacgccaagacaacagcaucuauuaccuggaggacaaggacuccguauugaaaacuaaggacugccuguuugcugacuauaacuaccacgacaagaauuauuauaaagacuaccccacgauauuccaccuccggcaagccuucauaaaagacacaguaaaagacgacgagaaucacacgagauacgcgcgacuauuauaccucgcuaucauaaacauguuugaacaccggggccacuuucuccuaaacaguguuagcgaagacauaaacaaagaaaugguuaaggacgcaggagaaggcuucacccucuaccuccaagagcgaauuaaagaaaucaaaccgguaagcuauucggacauauuggacguccuaguagaaaagaauauaagccgcagcgagaaaaaggaacgcaucgucgaacuauucgggaucaagaaaucgugcaagaacggaauggaaaucauaaagugucucugcgggcuagaagcaaacguagccauaauguucaacuuggacgacauagagaauaagcucacaauagucgucucaaaggacgacuacgaagacaagcuagcagaaguacaaccacucguagacgaagagagcuucgaacucuuaucgagaauuaaacaacuauacgacuacucucagcuacaaagcauccuaaagggguacaaggagaaagaggacggcgaagacaaguaccuuagcgacguccgcgucgagcuguacgaaaaacacaaagcggaccuaaaacuccugaaaaaggucuacaaaagggaccucgacaagaaagggaaaauuugcgaagggaaaaacauacagcgaagcuccaaguauaacuucauguuccgcuccgguaaagacggaacguacuccgcguacaccaacagcuugaacuccuucugcuccaagaccauagaaaauaaauacagacggaacaugaagaaccgcgaccgagcaagccuguacgacacaaucaagaaggacuuaucagggauagagaacgacgacgugaagaaaauacuccgugacauagagacugaaaaauuccugccgaaacagaucacgggagaaaacggcgucauacccaaccagauccaugccaaagaacuaaaggcaauccucaagaacgcagaaaaacaccuuccauuucucaccgaaaaggacgacuccggccuaacgguauccgagcgcauaauaucgcuauuccgauacugcauaccguauuacaucggaccggucggcaaagacucccgcaccggaugggcgagcauaaaggaggagggccagaucuuuccguggaacauagaacaaaagauagacguagacaaaacgagcgaagaguucauuacacgcuugaucaaaaccugcaccuaucuaagcaacgaaaaggucguacccaaacaaagccuagucuacgaacgcuacugcguccucaacgaaaucaacaauaucaagauccgcggaaagaggaucgacccccagcugaagcaagaaaucuucaaagagcuguacaucgguucaaaaugcgggaaaaagguaacccguaaaaaccugugccaauaccucgucaauaaaggugccaucgaggaagacagugaaauaucaggaauugauaaggaucucaacacauacaugagcagcuacggcaagauguaccagaucuucggggacaaaaucaaacgcgacgacaucaaagaaguugcagaagagauaaucuacuacggcaccauauaugguggcgcuaaggaaauguucaaaaagaaaauagaacaguacgugagcgaggacauucuggacgaagcccaaaugaaccguauauugggauuuaaauucaaagacugggcccgccucagcaagaaauuucuguaccucgaaggcuacgacaaaggcaaccaaaaucaacuuaccacgcuaaugcaagcacucugggacuacaaccucaauaccauggaacucaugaauagcccgauguucaccuucaaagagacccucgagaagcagaaaaacaaaauggaaaaaguccuaugcgacuucgaauacgaagaccuagaugaguacuacuucuccgcgcccguuaagcguaugguauggcaaaccauagcgugccugaaagaagugguccaaaucaugggccauaaccccaagagaauauucauugaaaugccccgcgccgacgaagagaagggggagcaaggcaggaaagcgagccgcaaaaaucgccuacuaagccuauacgaggagaucgaagacgaacgaccauggaagaaggagauagagaacgcagccgaauccggacgccucaacucgaaacgaauguaucucuacuaccugcaaaugggaaaggacgccuacacuggagaggacaucgacauagaagaccucuuugacaacuccaaauacgacaucgaccacaucuacccccguucccucacggacgacaacagccucgaaaacaacuuaguccucguguccgcgaccaucaaucaggacgugaagaaaaacgacuaccccauccccuacgacaaaauccgagggaacucaaaaguccgagagcuguggcgauuccuccacgagaagaaauuuaugaacgacgaaaaauacaacagacuaaugucagacgucccccucacccaagaacagcuggcaggcuacaucgcuagacaauuagucgagacggcucaggggaccaaaggcaucgccgacauaauuaaauccgucauaccugacgccgacauaauauacucaaaagccaaaaaugucucugacuuccgcaaacgguacggcaugcugaaaagucgccuaaccaacgacuuucaccacgccaaagacgcuuaccuaaacgucguaguaggcaacgucuacuucaccaaauucacacaaaacccacgcaaauacauuaaggaugaaaacgacaucgagaauaagaaguacaacuacaaccuuagcaagauguacgacaaagacguaauacgaaacggcaagguggccuggauagcacagaacgguaagaaagccgggacaauccagacgaucaaaaaggugauggaccgcaacacccccauaaucacccgccaagcguucgagcaaaggggcgagcucuacgaccugcaacccauaaguaaacacaaagccaagaaagaaaacuauguaccaaucaaggcaacaaacgagaaaaugaaagacgucacaaaguacggaggauucaccucccugaacccggccuacuucguauucguggaauacggcuccgcgaagaagagacaacggugcuucgcagucguucacagcuauugggcguccuccaucaaaaacaacgaggaccucguaacccaccucaaggaccguggcuacgaaaaccccauagucaucgcugacaaaauaaagaaaaacucccucauuaaguacaacggguauuuccucuacauuguuggcauggacgcucgaaagcaggucgaguucucaaacgcgacaucuaugugccucaacaacaauuucauccaguacauacagaagaucgaaaaagcgaacacgcugauugccgaagccaagaaacgccgcccguauauagacgaaagcauaacagcagaacgcaacaucgcguuguacaacgaauugaaaaagaaacaccuagacagcaucuucaaaaaucacccgaaagguaucggcaguguccuagagaguggagagggagcauucgugcaacuaagccuggagcaacagauaggcauacuauacuccaucauccaauuuagcucguucaagaaaggcacuuuuagucucacacucauaggcggaccuaaagaaguaggccggaucagaaucuccggcaacaugcccaaagcccgcgaacugaaacuaauucacuacuccauaacgggaauguacaagaaagaaaucaaccuccucgauuga

SEQ ID NO: 6745 - RNA, 4188 nt, Artificial Sequence
  Cas9 variant
auggaaacccaggccucgaaccaacuuauauccagccaccugaaaggcuacccaaucaaagacuacuucgugggacucgacauugguacuuccucaguuggaugggccgucacgaacaaagccuacgaacugcuaaaauuccgcagccacaagauguggggcucaaggcuguucgacgaaggugagagcgcggucgcgcgccguggcuuccgcagcaugcggcgccgucucgagcgacguaaacugcggcugaaacugcuggaggaacuguuugccgacgcgauggcucaaguugaccccaccuucuucaugcgccugcgugaguccaaguaccacuacgaggacaaaaccaccggccacuccucaaaacacauccuauucaucgauaaaaauuacacggaccaggacuacuacaaggaauaucccacuauauaccaccuccguguggcccuuaugaagucagggacagacgacauccgcaaacuuuuccuagccguucaccacauacugaaauaccgaggaaauuuccuguaugaaggagccaccuucgacuccaacgccagcacccuagacgacguucugaagcaggccuuggagaauaucacuuucaacuguuucgacagcagcgcagccauaggcucgaucggacagauacucauggaacuaggcaagacaaagagcgacaaggccaaagcaauagaacgccuagucgacaccuacaucaucacugacgaaguugacacuucagguaagacacaaaaggagcaggucaaggaggacaaaaagcggcuaaagucguucgccaaucugguucucggacuguccgcaucacuaaccgaccuauucgguuccgucgaggaucuugacgaggaccuaaagaaauugcagauaauaggagacaccuacgacgagaggcgcgacgaucuagccaaaguauggggcgacgaaauccauauuauagacgacugcaaauccguauacgacgccauaauacucaugucaaucaaagaaccaggccuuacgauaagcgagaguaaagugaaagcauuuaagaagcauaaggaugaccucgcgauccuuaaaucacuccuuaagagugaccgguccauauacaacaccauguucaaggucgacgaaaagggacuacauaacuacguucacuauaucaagcaggguagaaccgaggagacgucaugcaaccgugaagacuuuuacaaguacacgaagaaagucguggagggacugcccgacucgaaagacaaggaguacauacuaucagaaauagaacuacaaacgcuacugccccugcaacggauaaaagacaacggaguaauacccuaccagcuccaccucgaagaacuaaaagucauccuggcuaaaugcgggcccaaauucccguuccuuaaugaggucgccgacggauucucuguggcagagaaacucauaaaaaugcuugaguuuaggauaccauacuacgucgggccgcucaacacccaccacaacguagacaacgguggguucgcaugggcgguacgaaaagcgagcggccgagugacgccguggaacuucgaugacaagaucgaucgcgaaaagagugccgcggccuucaucaaaaaccugacuaacaaaugcaccuaccugcuaggcgaggacguccuucccaaaagcagccuacucuacagcgaguucaugcuccuaaacgaacucaacaacguacggaucgacggcaaaccccuugaaaaagcggucaaggaacaccucaucgaagccguauucaaacaagaccacaagaaaaugaccaaaaacagaauugaacaauuccucaaagauaacaacuacaucccagagaaacacaagcccgaaauuacaggacucgacggggaaaucaagaacgaccucgccuccuaccgcgacaugguucggauacuagggaacaauuucgaccucuccauggcagaggaaauaauaacagacaucaccaucuuuggagagagcaagaagaugcuccgagagacacuccgcaacaaauucuccucgagacuggaugacgaggccaucaaaaagcucagcaaacuucgauauagagacuggggacggcuuucacgaaaacuccucaacgucauagaaggcugcgacaaagccggcgacgggacacccgaaaccauaauuauccuaaugcggaauuucuccuacaaucuaauggagcuccugggcgacaaauucucguucauggaacgcauccaggagauaaacgccaaacucaucgaaggccagauagucaacccccacgacaucauagacgaccuagcccuuucaccagccguaaaacgcgcgguguggcaagcacuccggaucguggacgagaucguucacaucaagaaaacgcuucccgcacgaauauucguugaagucacucgcaguaacaaagcagagaaaaagaaaaaggacagccgacagaaaagacuuuccgaucucuaugccgcgaucaagaaagacgaugcgcuccugucagggcugacgaacgaagaguucggcggacuaaaaagcggacucgccaaguacgacgacgccgcucuccgguccaagaaacuauaccuguacuacacccaaaugggacgcugcgccuacaccggagaagucaucgaccucucgcagcucaacaccgacaacuaugacauagaucacauauacccccgcucccucacgaaagacgacuccuuugacaaccucguccucugcaaacgaaccgccaacgcccagaaaucagacaccuacccgaucuccaaagaaauccaaaaagcucaaaaagcguucuggauauuccucaagcagcaggggcucaucagugaacggaaguacgaaagacugacccggaucacgccacuaaccgcagacgaucuuucgggauuuaucgcccgccagcugguagaaaccaaccaauccgucaaagccgcaacuacccuccuucgccgucuguacccuggcgucgacgucgucuucguuaaagccgaaaacguaacugacuuccgacacgacaacgacuucauaaaggucaggagccucaaccaccaccaccacgccaaagacgccuaccucaacaucgugguaggcaacguauaccacgagcgcuuuacacgcaacuuccgagccuucuucaaaaagaacggcgcaaaccgaaccuauaaccuagcaaaaauguucaacuaugaugucaaaugcacgaacgcaaaagauggcaaagccugggccgucaaaacuucgauggacacagucaaaaagaugauggacagcaacgacguacguguaacgaagcgcguauacgaacaaaaagggcagcuaucagauaucaaccuaaccaaagcaagcaaaguaaaggccgacaucuaccuucccauaaaagccaacgaccccauuaugucacaaaacaugaaauacgggggauauagcgacaucaaaaacgcauacuacaccaucaucgaauacuccgacaagaaaaacaacuccaucaaagcauucauccccaucccaaucuucaucgcgacuaaaacacuaaccaaacaagcccuguuagaguauauaaaaacagucuugccaaaagccaacaaccuacgcaucauauauaagaaaguauacaacgaucaguuacuuaaaaucgacggcuuuaauuacuaucugggaggccgauccaacgaccguuucuguauugacaacgcuauucaacuuauagucccccuugaaauccaguucuacauuaagcuaguggaaaaauuuacagccaucaucucagagaacaaaaacaucgcccuaaaagccucauccguaaaaucccguaacccaauaaacaaccaaguggaaaauaucacccuagaguauacacagaaacucuucgacuacuuagucuccaaauucaacgaacugauuuaccucaaaaugaggggaaacaaacucaccgacguaaacaauaucggucguaaacaguucauaaaacugagcuuagaggaacgcugcaaagcacuagcagaacugcuaaacaucuucacaaacaugaauaagaaacuaucacuaagcacuaucaaugucuccgcaagccgaaaaguugucaacuuuaaaaucuccucccucgacgaguuuaaaauagugaacgaaagcauuaccggacucuacagccacgagaucaccaucgucuga

SEQ ID NO: 6746 - RNA, 4188 nt, Artificial Sequence
  Cas9 variant
augaaucuaagaaauacgacagacgaguacaacaucggacuagacauggggaccaauagcguaggcugggcggugacagauaaaguuggggcaaucgcucacuucaaggguaugcccacacucggcucgcgccuguucgaugcggcccagacagcagcagaagcucgagcacaucgcggccaacgccgccgguacgucaggcgccgcuggcggcuggaucuccugcaauccuuguuccaagacgagaucgacaagguagacucagaguucuucauaagacucagacagagcaggcuccacgucgaagaucgcgaagacgggcacgcggacuacaaguggcccaucuucaacgacagcgacuucacggaaguagacuacuacaaacguuuuccaacgaucuaccaccuaagaaaguggcugauagaaacagaccagaaggcugacauaaggcucauuuaccuagccguccacaauauagugaaacaccgaggcaauuuucuaagagaaaacaacaaaaaccuuucuucgcgcaacgcagacccagccgaggcagucggccaccuuaggcuagcccuuaacaacuggugucuggagagaggguacgaaugcgccuggaagucaggcggcaacgacaaugccauccucaacgugcucaucgacggagagaaacgucgcucggaucaaguccgggaaaucgccaaacuaacaggcaucgacugcggagacgcgaagcaaucaaggcaaugcaaugaagcaauugcaaaagccauaguaggacuaaaggccgagaugaaaaauaucuucggcgaguucccagcggagaaaacgcugaucuaccucuccuccgacgacgacguggaagucguacgagacgccugcccagacgacagcgucgaacuguuccaggcucuuugcgaacucuacgccgcauacauccuacagggacuacuguccuaugccccggggcaaacaauaucaguuaacaugguaaagaaauaugaucgguacggagaggaucuccaccuccuaaaagaacucacccggacguacgcaucaaagcgauaugacgcauuuuuccgaggcgaaacauacgaaggcucuagcgacuacguaguagacaaggcccaaggguacacacgcuacaaccuaggcaccacacaacuauccuacgacgacuuucagaaagcggucaaggagcuauucaagggcacagacgcacuacaggacgaacgguaucaaggaaugaugguugcguucggcgagcaaagguuccuacgacgccugaaaaccagcgacaacggaucaauauacuaccagcuacauuuagaggaacuucacgccauccuggaaaaccagggcaaacauuacccguuccuacucgcagaggaagacaaaauagagucccuuguuagcuuccgcaucccauauuacgucggcccacucaccagagaaaacgcggccgucggccacgacgggaaggaacgcuuugcaugguccagcagacgggacggcauggaacacgcagucaucacccccuggaacugggaggaaaucaucgaccgagacaaguccgccgaagacuuuaucaucaggaugacgggcgacugcacauaccuucaaggcgaaccagugcuccccaaaugcucacuucuauacgaggaguuuugcgcacucaaugagcugaacggcgcacacuggaccaucgacgaggacgacgagagacgcuucgacgcugcacaacgagaaagaaucaugugcgaccuauucagaagcacgcgcaaaguaacguacaagaaaguaucagacuggcucgaaagagaagauucuuucgucggggcgcgcguccacggcgggcagggcgaacacggcuucgagagccagcucggaagcuacaucuucuuuugcaaggacguauucaagaccgacucacuggacgaagccgacuacccaaugauugaacaaaucauacuauggagcacccuauucgaggaccgcgacaucuuaagacggaaaauagaagaggcguacggcgacaggcugaccacagagcaaaucaaagucaucugcaagaaacgguuugcaggcuggggacgucucucaaagaaacuuuuaacgggaauaaaaguugacacggacacaggcagaaaaagcaucauagacguccuccgagaagggaacccaaaugacgggcagcguagucggaccaugguguuuauggaaguccugcgagacgaaggguuaggcuuccaaaaagccgucgacgauuucaacagagacuauuucucggaacacaacaacggccucauggacgugaacgaccugcccgggucccccgcgauccgaagaagcauaaaccaagcaguacggauuguagacgaaaucgugucgaucgccaagaaagaacccgcaaacaucuucaucgagguaacacgggaagaggaugacccacgcaagaaaggcaaacgcacaaaaaggagguacgacgccaucaaauccgcccuagaggucuucaagaaagacgacccacaacucuggaaagagcuaaccaagaaagacuccaacaacauggacgaacggcuuagccuauacuucaugcaacgaggaaaaugcauguacaguggccgacccauuaaaauugaagaacuacauacgggaaaauacgaaguugaccacauaauaccccggagcuacaucaaagacgacucacucgaaaacaaagucuuagucuaccgcgaagagaaccaacacaaaacagacacacuccuaauagacucgucgauccgcagaaagaugggcaaauauuggcgaaugcuccacaacgcaaagcuaaucggcgacaaaaaguuucgaaaucuauuccgagaccacaucgacgacaaaacgaugaaaggcuucgucgccaggcagaucguagaaacgagccagaugguaaaacucguccaaacgcuucucgaagcccgauacccaggcgcacgcaucguacccguaaaggcgaacauaucccacgaccuaagagacgcagcaggacucguaaagugcagggaagccaacgacuuccaccacgcccacgaugcauuccuugcaugccgggucggucuauucauccagaagagacacccaagcguauacgacaacccgaucggcuuggcccacauaaugagagacuacgcacgagcacaagcgagagaauacaagaaaucccacuacuuagcccacaccaaaggauucaucgugaacucguuccuaucaucuggcuuugauaaagaaacaggggaaguuuucaaggacgacugggacgccgaagccgagguggaagguauccgacgggugcuaaacuaccggcagugcuucaucuccagaaugcccguugaagccacaggaacguucugggaccaaacgaucuacucaccaaaaugcggcaagaagcuaacgcucccacuaaagcgcggacuagaccccgaccgauacggcagcuacagcagagaacaauucgcauacuucuucaucuacgaagcccgggaccuaaagcacgaaagacauauacuccaauucgcgcagguuccagucagaguagcugcacacaucgccaaggauccaucccaacuggagagcuacgccguaaaacuggcgggacaggccaaccuagccuucguaagaaucgugcgacggcguauccuaaagaaacaauuacucgaacuaaacggagacaggcucauaauaacagguguacgagagguacgaaacgccacagaguucgcauucagucuagacgaagaaacacuaauagaacgcugcguccagauagcuaaaguagguagccucauagguguaguaaacgacgaagacgaggaacagcuuucagcggaucuaaacgaacucuucucgucccuaguuaaacgggggccgaaauuaugcaaucgccucuacgcccagcucaagcucgacaaauaccuaucaaaguucgacgaacugacccucacugacaaggcaaaaguuguacuccaacucaucgcgauaacaaauggcucaauaaacauggcagaucucagcgcacugggaagcucaaaauacgccgguugcaugcaggucagcuacuucaaacagcuaaacgcgccaauuggcgaggugaacauaaucgaccaaagcgugaccggcauguuugagcggagaacacauaucggccuguga

SEQ ID NO: 6747 - RNA, 4188 nt, Artificial Sequence
  Cas9 variant
augaaagaaauaaaggacuauauuauaggccuggauaucggaacaaacucgugcgguuacguggugaccgacaaacaaaauaacauccucaaacugaagggcaagaccgcgauaggggcccggcuauucaaggagggacaagcggccgcagaccgacgguccuuucgcacaacuagacgucggcucgcacgaagacacuggcgccuaggccuacucgaagaaaucuucgaucccgagauggaaaagauagacccgaacuucuucaggagguuaaaagaaucggauuacucccccaaagauucgcggaaacaauuuaacgcaaucgucuuuaaguccauuaaagccgacaagcgcuucuacaagaaguaccccaccaucuaccaucugcgcaacgccuuaaugcacgacaaucaaaaacacgaccuccgggagauauucauggcgguccaccacaucgucaaauaccgaggaaauuuccuaagagaagacucagucaacgcauuuaaagccgcgaaguucucacuccgaggcgaggacggcauuggcccgguagauaaacuaaacgaccuccucaaggagaucuauagcgaguacucccccgaacucgcuacuaacaaccuaagcaaaauagaagacaucaucaaagacaagaacuuguacaaacaagauaaacuuaagcaagucgcaacucuccucauaaaagaagcagacucuaaagacaaagcaaaacugaacaaagacaucgccaaacaagucgccaauuccuucaugggauacauguuccgacuggacacucucuucagccuaacagacguagacgucaaagacuacaaacucaaauucucugacgccaacauagacgaaucucuagacgaccugaccucacuucucaccgacgcucaaaucgaguucguccuagagcuccaauccauauacaacacgaucguucuuaacgaaaucguccccgacggaaugagccuuagcgagagcaugauuaagaaauacgacgaccacaaggaggaccuuaaaauauucaaagaguauauagacucccucuccgaccaaaagaaagccaagaaacuccucuccgcauauaacuuauacgugaacuaccgcaaauccgaccucguggaggcuaagaaccuauucaaaaacaagaaagucggcgauaaaaacuucgcagacgucaucucgaauuuugaagucuucggaaaauucgucuccgacaaccuggacgacagcgagcucgcgaacaagaucaaagcgagacucgaccucggggaguuccugcccaagcaacgaaccaaccagaacggcgucauccccuaccaacuccaccaagucgagcuuacgcaaauacuggaaaaacaaggcaaguacuacccguuccuaaucaccccaaacccuguugaaucacaccggaacaacgcacccuacgaaaucagcgagcuagucagcuuccgaguccccuacuacguagguccucuaauagauaaccaauccaucaaggacaagcaaaacaaaaacaaauucgcauggaugguccgacaaaaacaagggcagauaacccccuggaaccucgaagaaauggucgacacaacagaauccgcaaaccaguucaucaaaagaaugacacgcaaagacacauaccuacuagcggaagaugucuugccaaaguccucacucguuuaccaaaaauucaugauccuggacgaauuaaaccgaauuaaaauagacgggaaaaagcugaccuccgagcugaaacacgacauuuucgagaaacuuuucaagaaacagaaauccauuaaccucgacaacuuaaagaauuaccuccuaguagaagggaacauuccaggacucaucgaaggacuuuccgacggaaucaacuuuaacaacuccuucaguaccuacaucgacuaccgaaacaucuucggagacgaaaucgacaacccaaacaaacaggcagacuuugagaagaugauagaaugguccacaguuuucgaggacaggaaaaucuucaaacgcaaacuuaaggaaauaaccuggcucacaagcgaacaaauaaagcaaguaucauccaaacgauacucaggcugggggcgccucagcaagaagcuccucacccaaauaacagacgagaacggcguaaacauccuccagcgccuauggaacgaacccgagacccuaaccgaagucuuggccaacccagucaucaagcgcaagauaguggaagcuaacagcaguuucacuaaagcaaaggacaugaaagauauccucguagaagccuauaccaguccccaaaauaaaaaggccauucgacaagucaugagaguaguugaugacauuaucgccgccgcccacggcaaaaagccaucccaaaucgcgaucgaguucgcccgugaggaccaagacaacccccagaugaccaaaucccggaaggcgcagcuggaccaaauuuacgcgaaaauaucugacgaguuccuagacgacgccguaaagaaugaacucaaaaauaugaaggauaacaaaccucuagcgaaggacaaagucuuucuauacuuuaagcaaaugggucgcgacgccuacuccggugaaaaacuaagccuugacaaucuccaggacuacgacaucgaccacaucuacccccagagcuucauaaaggacgacucauucgacaacagaguccugguacaacgcgcguacaauaauggcaaaucagacaaugugcccguccuacuguucggcaacaaaauagcagcagggcucggcaucaccauuagacagauguggaagaaauggcucgaacucgggcucauauccaaacgcaaauucaauaaccuuaucaccgacccagagaaaauaagccgaaacauggcuuccgguuucguaaaccgccagcuaguagaaaccucgcaaguaaucaaacucgucgccaacauccugcaagcaaaguuacccgauacagaaaucaucgaaguaaaagcauccuauaacaguauauuacgaaaagaguucaacuuguacaaaagccgcgaagugaacgacuaccaccacgccaucgaugccuacuuaaccacaauagucggaaacuaccuuuaccaaguauaccccaaacuuagaccuuacuucgucuacggccaguucaaaaaguucggcaaggcagaaaaccaagaagacgacccggucaagaaaaucaagaaauucaacuucaucuaccaauuaauauggggaaaagacgacgcgaucugcaucucccacacuaaccaacaaguauucucaaagaaagacaucaucgacaaacucacaacggcguacaauuucaaauacaugaacaucucccacgcaguuuacacacgcaacaauaacauguucaaacaaacccuuuuccccauaauagaacguacgaccgcgaaaacgaaaucacucauccccaagaaacuugacagacccacggacauauauggaggcuacagcaacaauaacgacgcuuaccucgcacucgucaaaguagacaaaaagcgcggguccgaauaccgggucguagggauaccaaugcgcgcggcggccaugcucaaagccucgaaaaacuacgacgaggaccuacggaaagucaucgagccaauggucauguucgacaagaacggaaaggcgaaaaggggaauagaaggcuuuagaguccuaguuggcaagaugccauucaaacaggccguacuggacgggaacaagaaauucaugcucaccggcacaguagacacccccaaccugaaacaacucguccuaucacaacagaacaugaaauacauccuggacuacaucgaggacgucgauugucgaaaacacaaauucggugacaagguccaaaaucccgauaagugccuccuugaagucuucgaugaaaucauugaaaucguagacaaauacuucgaacuguuugacucgcgugacuucagagagaagcuacggaacucacgaaacaaauucaucaaacucgaagcaagcaagaaagcggacaccauacuggcaauacuaaaaggacuccaagccaaauccacccgagcgaccaucaaagagcuaaacaucucagacuucgggcggaucauuacuagcuccaucuccccggaggcgcaacucaucuaccaaucgccgacaggacuauucgaacgucgaguaaaaguuaaagaccucuga

SEQ ID NO: 6748 - RNA, 4188 nt, Artificial Sequence
  Cas9 variant
augucaaagaaauaccaaaacaccaaauacuacguagggcucgacaucggcacaucgucggucgguugggccgucacggacgcuaacuacgaacuccucaaagucaacggacacaagacgugggguagccgccucuucacggaagccgaaacagcacuggaacggcggacccacagagcgacccgccgccgucuucagcgacggaaacagcgccuagaccuguuagacgaacuauucgccgaagaacucgccaagguggacccucaguuccuucuacgccuaaaggagucccaauaccacauggaagacaaaagcacugaugauaaauacguccucuucaacgaccaaaaccguaccgauggcgaauuuuucacagaguaccccacaaucuaucaccuccgaucagaguuaaugcaagggaagaaggaagacauccgggccguauaccucgcgcuacaccacaucguaaaauaccgagggcacuuccuccuacccggcgauaacuacgacaugcagggcaaccuuuccgagcugauaaaacgccucuuuaaauucaucgaagaaacucuuuucauagaagaccuaggucugaccgacgagauccaaagcaaaauagaggaaauccuccugaccaagacuaaaacacgacuugacagacaaaaggaaaucgucaagcuauucaacacuaaacaccagaagcuagacgacaaacagaagaaacuccucgaagcaaucuucaaacuaugucugggacucaaaggcaacauggugaacauauucggugacaaaggcgaauacggaaucgacuucaccgacguagaagacaaaaagaaaaagguagaguucagcgcagauuacgacaacaacaucaacgauuacgucgacuucuuuggggaguacuucgagcugcucgagaucaccaagaagaucaacgacacgguaaucuucucggaaauccuaguagacggcaaaggcuucuccgaauccaagguaauuagcuacgaaaaacaccaacaagaccuccgaaaacuaaaaacgcuucucaaaagccuggacaaaacacuuggcuacaaguacggcgaaggacucuaccagaaaauacuucuggaugacguaaaguccaacuaugucaacuacuccggcaacucgcaaaagcucaagaaaugcacuaaagacgaguucuacggcuucauaaaaucaaaacucaacuccgucaccaagaaagaaaaaguaagcgaggcccaacaaaaagaaaucgcccagauccuggcggacauggaguucggugacuaucucccucuccagcgcacaaccgacaacggugucauccccaaccaacuacacaagaaggaacuaauugaaauaauagagcagcagacgaaguaccacgacuucuucaacgacgucgacgagaacggacucaccauaaaggacaagauaaucagcuugaugacguuccgcaucccguacuacgucggaccacugaacgacuaccacaaaguagccgacggcacagggcacgccuggauugagaaaaagaaagacggcaaaauauacccauggaacuucgacgagaugguagacaccgaagccacagccgaaaaguucauaaagaaucuuacaaacaagugcacguaccucaagggcgaagacgugcucccgaaagaaagcaaacucuauuccgaguucaugcuccucaacgagcucaacaacauuaaaaucgacaaccaaaaacucgaccccaagcucaagaugaagauggucuccgagcuuuucaugaagaaaaacgagaaaaucaccaaaaagaaaauagucgacuaccuccgcuccauaggacaggcaaacggaaacgaaauggugucgggcaucgaccgcgaaaucaaaucggaccucaaaacaauacauaaaauacaacacuauuaccaagacgcaagccuggaaauggcggaaaacauaauucguuggaacacgauuuucaacgacagcaccucggauauacugaaagacaaaaucaccaaggccuacggcgacguacuaacaccaggccaaaucaaagggcucagcaaccucgccugcaaggacuggggaaaacuuucugagaaauuucucacaggcauaagaugugacgugggcgaguucaaaaacaucuccaucauacaagccaugagagacaccaacaauaaccucauggaacugcucagcaauaaguacgaguucauggauaaaauccaagaauacaacaaagaauacuacggagacuuuacguucaaggccgaaccaucgauaauggaugaccuuuacgucgggccaggcccaaagcgcgccauauggcaggccguccgcauaguagaagaaauaaaacgaauaaugggccacgacccggaaaagaucuuccucgaaacaacccgcaccaaccgagcccccaaggucaagaauacuaaacgcuacgacgcacucgaaaagaaauacgaaucugucaaggaacacgaauacgcggaggucaagaaagaguucgaaauagagaaaaacgacucccuaaauaucaagaaacucuuucuauacuucacacaacuggggcauuguauguacuccgaugagaaaaucccauacaacgaacuguuuaccaaucgcuaugacaucgaccacaucuacccgcguuccaaaaccagggacaauucaauggacaaucuaguacucgucaaagccgaauguaaccgcgacaaaaaggacaacuaucccauaaaacugaagacgaacauacagcagaaaugucaaguccgaugggcguaccucagggauaagaaacuaauaaccgaagaaaaguacaaucggcuaguacgcaagaccccuuugaccgaagacgaacugucucaauuuauugcacgccagcugguguucacaucccagucaguaaaagccacugcagagguauucaaacgccucuacgaggacucaaaaauuuguuauguaaaagcagagaacgucuccgauuuccgcuacggauccacucgcaaaaugucuaaagacgaccaaccccagccguuuaucaaaaaucgcgacguaaacgacuuccaccacgccaaggacgccuaccucaacauaguaguagguaacguuuacgacgugaaauuuacccagaaucccacacgguucaucaaagcuaauaaagacuauucccucaacuauauauuccguuacccuguuaacaagaaaggugaaaacguaugggacccagaacaauccaugaaaauaguagagaagacgcucaagagcaacgacgucagagucaccaaacugguuaagccgauaaccucgccaauaagcaacgagacguuacacaaagcccucaaauguaaacccggauccuaccugccucguaaaagcagcaaaggcacgccacucgcagacgucaccaaauacggcggcuacgagaaaauaaagaacgccuacuacuccaucuacaaauauaccuauaugaaaaagaaagaaugcauggaggaguucuugcuaguccccauacccauccaccuagucaauaacgacgaagaguuaccaaaauacauuaacgacaagauagccgaaagggccaaaaagaagaaacucgaaacuguagagugcaucgucaaagaacuuuaccaggguacucuuguacgaauaaacggcuacgacuaccgaaucgcaggcaguagcggaaaacaauuugaacuccacaacggcaucaaccugaucguagaacccuggguagagaaagugcugaaagaaaccgacaaguucgucaggaaauccaacuccaaacuggacaaaaagcaacaaaaggaaaacaccacagaaacccucaucgaaaaacaacucaaugacgucuucgaguacuuaugccgaaagcugaaccaagggaucuucaaaaauaacaaacacacccuaccggccaaacugcucggcgauagcauacagaaaagguucgaagacgccagcauugaggacgaguuugaagugauaaaggaacucauauccgcuaucgccaaaaacccccaaaacuucaagacgauccaaaaaguccuggacauuucggggucaucaauccccagguucaacuugaagcuaacgaaaaacaaugucgacgaguucaucauaaagaacgaaagcgucacaggacuguucacacacgaaaaggugaucuuccgcaaauga

SEQ ID NO: 6749 - RNA, 4188 nt, Artificial Sequence
  Cas9 variant
augaagaaagaaaucaaggacuacuuccuaggcuuagauguagguacaggauccgucggcugggcgguaaccgacacggacuacaaacuccucaaagcgaauagaaaagaccuaugggggaugcgaugcuucgaaacagcggagaccgcagagguccguaggcuacaccguggggcucggcgaagaauagagcgcagaaagaaaaggauaaagcugcuccaggaacucuuuucccaagagaucgccaaaauagacgaaggcuucuuccagcgaaugaaggaaagcccccuauacgcagaggauaaaaccauccuccaagagaacacacuuuucaacgacaaggacuucacggacaaaaccuaccacaaggccuacccuaccaucaaccaccuuauaaaggccuggaucgaaaauaaaguaaagcccgacccucgucuauuauaucucgccugccauaacaucaucaaaaagagaggucacuuccuguucgaaggcgacuucgacagcgaaaaccaauucgacacuagcauccaagcacuuuuugaauaccuccgcgaagacauggagcuagacaucgacgcugacagccagaaagugaaagagauccucaaggacucaucccucaaaaacagcgagaagcaaagccgacuuaauaaaaugcucggacuaaagccaagugacaaacaaaagaaagccaucaccaaccugauaucggggaacaaaauaaacuucgccgaccucuacgacaauccggaccugaaagaugccgagaaaaacucaauaucguuuucaaaagacgacuuugacgcccucagcgacgaccuagcgagcauacucggggacucuuuugaacuccuccuuaaagccaaagcaguguacaacugcuccguccuuucaaaagugauaggcgacgaacaauaccuaaguuucgcuaaagucaaaaucuaugagaaacacaagaccgaucugaccaagcucaaaaaugucauuaaaaagcacuucccaaaggacuacaagaaagucuucggcuauaauaaaaacgagaaaaacaacaacaacuauagcgcauaugucgggguaugcaagauaacucacaagaaacucguaauuaagaacuccgccagccaagaagacuucuacaaguuccuaaagacuauccucuccgcaaaaucagaaaucaaagaagucaacgacauccucacagaaaucgagaccgggaccuuccucccaaaacaaaucucgaaauccaacgcagagauacccuaccaacugcgaaaaauggaacucgagaaaauccuaagcaacgcagaaaaacacuuuaguuuccuuaaacagaaagacgagaaaggucucucacacagcgagaaaaucaucaugcuacucacauucaagauccccuacuacaucgggccaaucaacgacaaccacaaaaagagcuucccagaccgaugcuggguggucaagaaagaaaagagcccaagcggaaaaacuacaccguggaacuucuucgaucacaucgacaaagagaaaaccgccgaagaguucaucaccucccgcaccaacuuuugcacuuaucugaucggcgaauccguguuacccaaaagcagccuccucuacucagaauauaccguccucaacgaaauaaacaaccuucagaucaucauugacggaaagaacauaugcgacaucaagcucaagcaaaagauuuacgaagaacuauucaagaaauacaagaaaauaacacaaaaacagauuucgacguucauuaaacaugaaggaaucugcaacaaaacugacgaagucaucauccugggaauagacaaagaauguacaucaucccucaaauccuacaucgaacugaagaacaucuucgguaaacaaguagacgaaauaagcaccaagaacaugcuagaagagaucauccggugggcaacaaucuaugacgagggcgaggggaagaccauauuaaagacuaaaaucaaagccgaauacggcaaauacugcucagacgaacaaauuaagaaaauacucaaccuuaaauucucuggcuggggcaggcuaucgcgaaaauuccuagaaacagucacgagugagaugcccggauucucggaacccgucaacaucaucacugccaugcgugaaacccaaaacaacuugauggaacuucuaucuuccgaguucaaauucacggaaaacauaaagaaaauaaacucaggcuucgaagacgcagagaagcaguucucauauaacggacuggucaaaccacuuuuccucagcccaagcgucaaaaagaugcucuggcagacacuuaagcuagucaaagagaucagccacaucacccaagcaccgccaaagaagaucuucauagaaauggcgaaaggagccgagcucgaaccagcccgaaccaaaacacgacuaaagauacugcaagaccuauacucaaguugcaagaacgacgcggaugccuucucguccgaaauacaauaccucuccggaaaaaucgagaacgaggacaaucuucgcuugcgcagcgacaagcuauaccuguacuacacacaacucggcaagugcauguacugcgggaagcccaucgaaauaggccacguauucgacacauccaacuacgacauugaccacauauacccccaaucgaaaaucaaggacgauucaaucuccaaccgaguucucguaugcagcagcugcaacaagaacaaggaggacaaauacccccuaaaagcagaaauccaaucaaagcaacggggcuucuggaacuuccuacaacggaacaacuucaucagccucgagaaacuaaaccgacucacccgcaccucccccauauccgaugacgaaacagccaaguucauugcgcgccagcuggucgagacccgccaggccacgaaaguggcagccaaaguccucgagaaaauguucccugaaacaaaaaucguauauucaaaggcagaaacagucuccauguucagaaacaaauucgauauaauaaaaugcagagaaaucaaugacuuccaccacgcccacgaugcguaccugaacaucguagucggcaacgucuacaacaccaaauucacaaacaacccauggaacuucauaaaagaaaagagagacaaccccaagaucgccgacaccuacaacuacuacaaagucuucgacuacgacgucaaacgcaacaauauaaccgcgugggaaaaaggcaaaacaauaaucaccgucaaagacauguuaaaaagaaacacaccgaucuacacucgacaagcggcaugcaaaaagggggaacuauucaaccaaacaauaaugaagaagggacuaggccaacauccgcucaaaaaggagggcccgcugucgaacaucucaaaguacggaggcuauaacaaggugagcgcugcauauuacacacugauagaauacgaagaaaaagguagcaaaauucgcucccucgagaccauaccacucuacuuaguuaaagacauacagaaaaacaaggacggucucaaaucuuaccucaccgaucaaaucgggaaaaaggagaucaaaauucugauaccuaaaaucaaaaucaacucccuacuuaaaauaaacgguuucccaugccacauaaccggaaaaaugggcgaggcauucguccuucgaccggcuguccaguuuugcugcucgaacgacgaagcgcuauauuucaaaaagauaauucgguuuaacgagauucggaaacaacgagaaaagaugggaaaaacaauuuccccauacgaggaccucagcuuucgcaguuacaucaaagacaauuuauguaaaaagaccaaggcagacgagauagaagaaaaagaguucuacgaccuccugcagaaaaagaaccuggagaucuacgacaugcugcucaccaaacacaaggacaccauauacaagaaaagaccgaacagcgcaaccauagacauccucgucaaaggcaaggagaaguucaagucccucaucaucgaaaaccaauucgaggucauucuagagauacuaaaauuauucagcgcgacuagaaacguaagcgaccuccaacacaucggcggguccaagaacgcagggaaugcccggguggggaacaaaaucucuagcuuggacaacugcauccugaucuaccaaucaaucacgggcauauuugaaaaacgcauagaccugcucaaaaucuga

SEQ ID NO: 6750 - RNA, 4188 nt, Artificial Sequence
  Cas9 variant
augucauucaagaaaauccucggacucgaugucggaguagcaucaaucggcugggcugugguacgagaaaacgaagaaaacccaaacuucaacacaauaaccaaacuugggguccgcguagugcccauaacaucggacgaaaaauuaaacuucgaaaaagggaaaagcaucacuuccaaugccgaacgcacacucgcaagaucuucccguagaaaucuccagagguuccgccucagacgcaaaaaccucaucgcuauccuccugcaaaaccaaauaaucacccccacaacaccucuaaccgagaaagggaaauucacgacuuuugaaacacuaaaaauacgugcuaaagcaacgaaagaaaagauagaacuagaagaacuagcucgugugcuccuccacaucaacaagaaacgcggcuacaaaagcucacgaaaagucaaaaacagcgaagacggaaaagccaucgacggcauggaagcggccaaaauccuauacgaaaacaaacuaaccccaggucaauacaccuaucaauuacucgaaaaaggcuccaauaaaaucccagacuucuacugcucagaccuccagauagaaugggaaguuauauggaacuuccaaaaacaauucuaucccaacuuacuaaccgaagauuucaagaaagaacucaaaggcaucggccaaagggccaccgcugcacucuuccucaagaaauacggcauauacacugcgcuaaacaaaggaaaacgagaagagaagaaacuccaagccuacaaauggcgcuccaaauccguguccgaaaagaucccgguggaggaacuagcguacgucauagccgaaaucaauucccacaucacgaacuccuccggcuaucucggcacaaucuccgaccguuccaaggaacuguauuucaaccaacagaccaucggcgaaaaucucuacgcccaggucgccaaaaacacccacgcgaaacuaaagaaccaggucuuccuccgccaagacuacuccgccgaguucgagcaaaucugggaaacacaagccaaauuccacccacagcuaacacccgaacuaaagaagaaaauaagagauuccauaauauuuuaccaacgcaagcuacgcucucagaagcgccucauuagcaucugcgaguucgaaaaccgcgaaaucgagaucauuaaaaauggcaagaagaagaagaagaaaauaggacuaaaagcggccccuaaauccuccccacucuuccaggaguucaaaaucuggcaaguccugaacaacaucguaauuaaacaagaaggcaaagaccggcuccuaacgugggaagaaaaagaauuacucuuuacagagcuaaacaucaaaggcaacaucagcggacaaaaggcgcucgcccuccugaaacugaguccgaaagauacaaagauaaacguaaccauccucgaaggcaaucacacacaagaacaacuauaccgagucuaccugcguauccuagguauggagggcuaugacgucuucgaccuccuaaagauaccagaaaaucaagacgagaucaaaccggcagacucaaagauaagcgcugccgaaauaaaggaaacagucaaauccgucuucaaaacaugcagcauaagccccucaauccuggacuucgacccacugcuccccaaccccgaguucgaaaaucaaagcucguaccaacucuggcaucuucuuuacucguacgaaggugacaguagccccagcggcaacgaaaagcugcucgaacuacuaaagaauaaauucggauucaagaaagagcacgcgcuucugcuagcaucaauuucauacaccuacauauacggcaaccucuccagcaaggccaugagaaaaaucuaccccuacucuaaagaaaacacauacuccgaagcaugcaugcuggccggauacagacauuccaaaaacgcccuuccucgggaagaguuaguaaaauaccaacuaaaagaccgacuagaaauccuuccgaagaacagccuccgcaacccaguggucgagaaggugcucaaccaacucauaaaccugguaaacucccuaauggacgaguacggggccuuugacgaaauccgccucgagauggccagggaacuuaaaaagaacgcgaaggaaagagaaaaguggucgaaaaacaucgccgacgccacaucccggaaccagaaacacgcggagauucuaaagaaagauuucaaaaucuccaaccccagcaaaaacgaccuaauccguuauaggcucuaccuggagcuuaaggccaacggcuacaacgaccucuauacaaacaccuacauagacauaaauuaccuauucacacaccgcuacgacaucgaccauauuauuccgcaaagcaaagucuuggacgacuccuucucaaacaaaguacucguuccgaggcaagcgaaccucgagaaaagcaaccucaccgcauucgacuacaucucacaccaaggaaaagagaaagaagaacacuaccuaaauguaaucaccgagcucuauaagcgcggaaguaucuccgaaaccaaauauaaaaacuugcagaagaaaggcaacgagaucggagaggguuucaucaaccgggaccuaaagaacacccaauacaucguacgcaaagcgcgggaaauccucaguuuaauaacaccuaacguagugaccacaaccggcgagauuacagcaaaacuccgcaaagacuggaaccuuaucaacuccaugaaggagcugaacauggauaaguuccgcaacgcacggcuuaccgaguuaguggaaaacucacguggcgaaaagaaagagauuauaaucgacuggaacaagcguaacgaucaacgacaccacgccaucgacgcccuuguuguagcauucaccaccagaaaccacguacaauaccucaauuacaugaacgcgagggaggacgaaagccacaagcaacacucgcauauucuaucaauagaaaagaaaaucaaauacgauaaauuccacgagaacggcagccgacagagccgcuucaucuauccgacgagcaacuuucgcgaagaggcaaagaagaaacuaaaggaaauacuuguaagcuacaagaccaagaauaaagucgucaccgucaacaucaacaagccgaagaaaaagggcggcuacaguccuaaacacgagcuuacaccccgcggccccuuacacaaggagaccaucuacggaaugauucgcauacuacacaccaaagaaaucaaggucaguucgaaacugaacuucgagacagucgucagaauccaaaacccacgauaccgcaacgccuuacuugaaaggcugaaagacaacuucaacgaccccaagaaagcauucagcgggaccaacagccuuaccaagaacccaguauuucuaaccgccaacucaaccgagacagugcccgagaaagucaccauccagugguucgagaaggucuacacgauccgcaaacccaucaaucccacuaacuucaaaaacgagaagaacaucgaaaagguacuagacccaacgauccgaacacuccugaaaaagcgccuacaagaauacaauggaaacgcuaaagaggccuucucagaccucgagaaaaaccccauauggcucaaucaagaaaaagggauuugcaucaagacgguaacuaucaccgguauaagcaauguggaaagccuccauaccaagaaagaccacuuugggaaagaacugcuugacaucaacggcaacccuaucccgguagacuucgucucaaccggcaacaaccaccacguugccauauacgaagauuccgaaggaaaccuacaagagaaaguugucucauucuacgaggccgucgaaagggucaaccaaggccuccccgucauagauacccuguauaaccuggaccuuggauggaaauuccucuucaccaugaaacagaaugaaauguuccuauuccccgcggacgacuucgauccgaaugauauagacaucuacgacgagaaaaacuuaauccugauaucaaagcaccucuuccgaguacaaaaacucucgagcaaggacuacugcuuccgacaucaccuugagaccuccauuaauuucaacgacccugcacuuaaaggaauaacauggcggagagaaagcccaaacggcuuacgcaaccuuguaaaggugcguuuaaaucaucugggcaaaauuguacacaucggcgaauga

SEQ ID NO: 6751 - RNA, 4188 nt, Artificial Sequence
  Cas9 variant
augaagaaagaaauaaaggacuacuuccucggccucgacgugggaaccggauccguaggaugggcagucacagauacggacuacaagcugcucaaggccaaccacaaggaccucugggggaugagaugcuucgaaacggcggagaccgcggagaagcgccgccucuuccgaggugcgagacgcagaauagaacgacgaagaaaaaggauuaaacuccuacaagaacuguucucacaagaaauagccaaaauugacgaagacuucuuccagcgcauggaagagagccccuuuuacgccgaggacaagaccauccuacaggaaaacacccucuucaaugaccgugacuucacagauaagaccuaccacaaggcauacccaaccaucaaccaucucauaaaagcauggaucgagaacaaagucaagccugauccgcgacuccucuaccuggcaugucacaacauaaucaaaaagaggggccacuuccuauucgagggcgacuuugacucugagaaccaauucgacacaagcguacaagcccucuuugaauaccuccgggaagauauggagcucgacauagacgccgacucgaaaaagauaaaagaaauccuaaaagacucugcccugaaaaacucagacaaacaaaaccgccuaaacaagcuccucgggcucaagucaucggacaagcaaaagaaggcacucacaaaccuaauaucaggcaacaaagcgaacuucgccgaucuauacgauaacccagaccugaaagacgcagagaagaacucaaucucauucucuaaggacgacuucgacgcgcucagcgaugaacucgcgagcgugcucggagacagcuucgaacugcucuuacgugcaaaggccgucuacaacugcucagugcucuccaaggucaucggcgacgaacaguaucucagcuucgcgaagguaaagaucuaugaaaagcacaaaaacgaccuaaccaaacucaaagaagucgucaaaaaguacuuccccaucgaguaccgcaacaucuucggcuacaaacaaucggagaacaacaacuguaacuacucccgguaugucggggucugcaagagcgguuccaagaagaaaguuauaaacaagaccgcaucgcaagaggacuuuuacaaauuccuaaaagacauacugcuaaagcgaagcgacgucccggaagcgaacggaauccuaacagaaaucgagaccgggaccuuucuccccaagcagauauccaaaaauaacgcggaaaucccauaccaacugcgaaaaaucgagcuagaaaagauacugacgaacgccgaaaaguucuucagcuuccucaaacaaaaagacgagaacggccucucccacucagagaaaaucaucaugcuacucaccuucaagaucccguacuacaucgggccaauuaacacaucccacaaacaguauuucccagaccgguccugggucaucaagaaagaaaacgcaccccaagaaaagauuacuccguggaacuuuuucgaccacauagacaaggaaaagaccgccgaagccuucauaaccagccgaacgaacuucugcacuuaccuuauaggcgaaucgguccuucccaaaaauucccuccuauacagcgaauacaccguccuaaacgagauaaacaaccuacaaaucaucauagacggaaagaauauaugugacgucaaacugaaacagaaaauauacgaagaacucuuuaaaaaguauaagaaagucacccaaaaacaaauaaguacauuuaucaagcacgagggcaucugcaacaagacagacgaagugaucauacucggaauagauaaagagugcaccuccagccuaaagagcuacauagaacuaaagaacaucuucggcaagcaaguugaugagauaucaaccaaaaauaugcuagaagauaucauccgcugggcaaccaucuaugacgaaggagagggaaaaaccauccucaaaacaaaaaucaaagcagaauacgaaaaauacuacuccgaugaacagaucaagaaaauccuuaaccugaaacuuuccggcuggggaaggcuaagucgcaaauuccuggaaucaauaacauccgaaaucccaggcuucaucgagccagugaacauuauaaccgccaugcgagagacacaaaacaaccucauggaacuccugucaagcaaauucaaauucaaugaaaacaucaagaaaauaaauucugguuucgaagacacagacaaacgauucagcuacaacagccucguaaaaccacuguuccugagccccuccguuaagaaaaugcuguggcagacacugaagcucguuaaggaaauaucacauauaacccaggccccacccaaaaagauauucaucgaaauggcaaaaggcgccgagcuggaaccagcccgaaccaaaacuaggcuaaagauccuccaagaucucuacaacucaugcaaaaacgacgcagacgcauucagcuccgagauccaauaccuccucgggaaaaucgagaaugaagacaaccugcgccugcguagcgacaaacucuaccuauacuacacacagcucggaaaguguauguacugcggaaagccaaucgaaaucggccaugucuuugauacaagcaaauaugacauagaccacaucuacccccaaagcaagauaaaagacgacuccauuaauaaccgaguuuuaguaugcuccucaugcaacaaaaacaaggaggacaaauacccacuaaaaccugaaauucaacuuaaacagaagaaauuuuggaauuuccuacaaaggaauaauuucauaucaauagagaaauucaaccgacugacucggaccacacccauaucggacgacgagacagcaaaauuuaucgcucgccagcuaguugagacgcgccaagcaaccaagguugccgccaagguacuggagaagaucuuucccgaaacaaacaucgucuacagcaaggcggagaccguuagcauguuccgcaacaaauucgacauaaucaagugccgcgagaucaacgacuuccaccacgcccacgacgccuacuugaacauagucguggguaacgucuauaacacgaaauucaccaauaacccguggaacuucauaaaagagaaacgggacaauccuaaaaucggcgacacuuacaauuacuacaaaguguucgacuacgacgucaagcgaaacaacaucaccgccugggaaaaagaaaagaccaucauuaccguaaaaaccaugcucaaacgcaacaccccaauauacacgcgacaagccgcgugcaagaaaggagaacuguucaaccagacgauaaugaagaagggccucggccaacauccacuaaagaaagaaugcccauucucaaacaucuccaaauacggcggcuacaacaaagugucagccgcauacuacaccuucauagaguaugaggagaaagguaacaaaauacgcucacuggaaacgaucccccucuaccucgaaaaagacauccaaaaaucccaagacgggcuaaagggcuaucucaccgaccagcucggcaaaaaggaaaucaagauacucguacccaaaauuaaaaucaacucccucuugaaaaucaacggauuccccugucacauaacaggaaagacaggagcgagcuucgugcugcgccccgcgguccaauucugcugcucgaacgaugagguacuauacuucaagaagaucauccgauucaacgagauucgaucgcaacgugagaaaaugggaaagacgaucagcccguacgaagacuugagcuuccggucauacaucaaagaaaaucucugcaagaaaaccaaaaacgacgagauuggagaaaaagaguucuacggcuuccuccagaagaaaaaccucgagaucuacgauaugcuacugaucaaacacaaagacacaaucuauaguaaacgcccaaacucgacgacacuagacauguuaaucaaaggcagauacgaguucauaaaccuaaagcccgaagaccaaauccgcguaaugcuggaaaucuugaaacuguucugcaccaccagagagguaaucgaccucggccuaaucaaagggaaaucugaagcuggcguaacaacacuaggcaagaagaucucuaaccuggacagcugcauucuuaucuaccagagcauaacuggaaucuuugagaaacgaaucgaccugcuaaaaauauga

SEQ ID NO: 6752 - RNA, 4188 nt, Artificial Sequence
  Cas9 variant
augaagaaagagaucaaagacuacuuccuuggguuagacgucggaaccggauccgucggaugggcagucacagacaccgacuacaaacuucuuaaggcgaaccggaaagaccuauggggcaugagaugcuucgaaaccgccgagaccgccgaggugaggaggcuacaccgcggcgcccgacgacgaauagaacgaagaaagaaacgaaucaaacuacuccaagaacucuucucacaagaaaucgcgaaaaccgaugaaggcuuuuuccaaaggaugaaagaaagccccuuuuacgcggaagacaaaaccauacuucaagagaaugcgcucuuuaacgaccgcgacuucaccgauaaaaccuaccacaaagccuaccccaccauaaaccacuuaauaaaagccuggauagagaacaaagugaagccggacccccgccuacuguaccuugccugucacaacauaaucaagaaaagggggcauuuccucuucgagggcgauuucgacuccgaaaaccaguucgauacgucuauacaggcauuauucgaauaccugcgcgaagacauggaagucgacaucgacgccgacagccagaaaguaaaggaaauacugaaagacucgagccucaaaaauagcgagaaacaaagccgacugaacaaaaugcuggggcugaaaccguccgacaagcaaaagaaagcaauaacgaaccucaucagcggcaauaaaauuaacuucgcagaccucuacgauaacccagaccuaaaagaugcugagaaaaacagcaucucguucucaaaggacgacuuugacgcucuguccgacgaccuagcuucgauacugggggacucauucgaacuccuccuuaaagcaaaagccguuuacaacuguagcguacuguccaaagucaucggagacgagcaguaccugagcuucgccaaagugaaaaucuacgagaagcacaagaccgacuuaaccaaacugaaaaacguaauaaagaaacacuucccaaacgacuacaagaaggucuuuggcuacaacaaaaacgagaaaaacaacaacaacuacuccgccuauguugguguaugcaagacaaaaucgaagaaacucgucaucaacaauacagucaaccaagaagacuucuacaaauucuugaaacccauccuacucgcaaaaucggaaauaaaagaagugaacgacauacucaccgagauagaaaccggaaccuuccuaccaaaacagauuuccaaauccaacgccgagaucccauaucaauuacgcaagauggaacuggaaaagauacucaguaacgcagaaaaacacuucagcuuccuaaagcagaaggacgagaagggccucagccacuccgaaaagauuauaaugcuccucacauucaaaauucccuacuacauagggccgauaaacgacaaccacaagaaaucuuucccagaucgcugcuggguaaucaaaaaggagaaaagcccgagcggcaagaccaccccauggaacuucuucgaccacauagacaaagacaagacagcagaagccuucauaacaucucgaacuaacuucugcaccuaccuagugggggaaucgguacucccgaagaacagucuacuguacagcgaguauaccguacuaaacgagaucaacaaccuacaaaucaucauagaugguaaaaacauaugcgacauaaaacucaaacaaaagauauacgaagaacucuucaagaaauacaagaaaaucacccaaaaacaaaucucuaccuucaucaaacacgaagguauaugcaauaagacagacgaggucauaauccucggcaucgacaaagaaugcaccagcucccucaaaagcuacauagaacuuaaaaacauauuuggcaagcaaguagacgaaaucuccacgaagaacaugcucgaagagaucauccgaugggcgaccauuuaugacgaaggugagggaaagacaauccucaaaacgaagauaaaagcggaguacggaaaauacuguagcgacgaacaaaucaagaagauccuaaaccucaaguucucuggcuggggccgccucucccguaaguuccuagagaccgucacgucagagaugccagguuuuuccgaacccgucaacauaaucaccgcgaugcgggaaacacaaaacaaccucauggagcugcuaucaucagaguucaaguuuaccgaaaacauaaagaaaaucaacuccggauucgaagacgucgagaaacaauucuccuacgacucccuggucaaaccccuauuccucucccccagcgucaagaaaaugcucuggcaaacccugaaacucguaaaagaaauaucgcacaucacucaggccccacccaagaagaucuucaucgagauggcgaaaggagccgaacucgaccccguccgcacaaagacuagacugaagauccugcaggaccuuuacaacaacugcaagaacgacgcggacgcauucucaucagaaauuaaagaccuuucaggcaaaauagaaaacgaggacaaccuccgacuacgguccgacaaacuauaccucuauuacacacagcucgggaaaugcauguacugcggcaagcccaucgagauaggucacguuuuugacacguccaacuacgacauagaccacauauacccgcaaucgaaaaucaaggacgacagcauuagcaaccguguccuaguauguuccagcugcaauaaaaacaaagaagacaaguacccccuuaaggccgaaauccagucuaagcaacgaggauucuggaacuuucuacagcgcaacaacuucaucucgcuggaaaaacucaaccgccucacaaggacaagcccaaucucggacgaugaaacagccaaguuuauagcgcgucaacucgucgaaacacgccaagccaccaagguggccgcgaaaguacucgagaaaauguuccccgaaacaaagauaguauacagcaaggcggaaacugucagcauguuccgcaacaaauuugacauuauaaaaugccgcgaaaucaacgauuuccaccacgcgcacgacgcauaccuaaacaucgucgucgggaacgucuauaacaccaaguucaccaacaaccccuggaacuucaucaaagaaaagcgcgacaaccccaagauagccgacacguacaauuacuacaagguauucgacuacgaugucaaacgcaacaacaucaccgcuugggaaaagggcaaaaccaucaucaccgucaaagacaugcugaaacgaaacacccccauuuacaccaggcaggccgcgugcaagaaaggggaacuauucaaccaaacuaucaugaagaaaggacucggccaacaccccuuaaagaaggaagguccccuaucaaacaucuccaaauacgggggauacaacaaggucagcgccgcuuacuacacccucauagaauacgaagaaaaaggcuccaagaucaggagccucgaaaccauaccccucuaccucguaaaagacauccagaaaaacaaggaugggcucaaguccuacuugaccgaccaaauaggcaagaaagaaauaaaaauucucauaccgaagauaaagaucaacagccuccugaagauuaacggauuccccugccacauaaccggaaagaugggugaagcguucguccuccgccccgcaguacaauucugcuguuccaacgacgaagcauuauacuucaagaaaauaaucagauucaacgaaauacggaaacaacgggagaaaauggggaaaaccaucuccccguacgaagaucugucauuccgcucauauaucaaggacaaccucugcaagaaaacaaaagcggacgagaucgaagaaaaagaguucuacgaccuacuacaaaagaaaaaccucgagaucuaugacaugcugcucaccaaacacaaagacacuaucuacaagaaacgccccaauucugcaacgaucgacauccuaguaaaaggcaaagaaaaauucaaaagccugauaauugagaaccaauucgaagucauacuagaaauucugaagcucuuuagcgcgacccgaaacgucagcgaucugcaacacauaggcggcagcaagaacgcgggcaacgcuagggucgggaacaaaauaucaucccucgacaacugcauccugauauaccaauccaucacuggcaucuucgagaaacguauagaucuacucaaaauuuga

SEQ ID NO: 6753 - RNA, 4188 nt, Artificial Sequence
  Cas9 variant
augaagaaagaaauaaaagacuauuuccugggucucgacguugggacaggcuccgucggaugggcggucacugauaccgauuacaaacuacucaaagcuaauaggaaagaccuaugggggaugaggugcuuugaaacagcggagacugccgaaguccgccgccuucaccgaggagcccggcgccguaucgaaagacgaaagaaacgcauuaagcuacugcaggaacuguucucccaagaaauagcaaaaaucgacgaaggguucuuccaacgcaugaaggaauccccguucuacgcggaagacaaaaccauacugcaggaaaacgcccucuucaacgacaaggacuucacagauaagacguaccauaaagccuacccgacgaucaaccaccuaauaaaagccuggauagaaaacaaaguaaagcccgacccccggcuauuguaucuagccugucacaacauaaucaagaaacgcggccacuuccuauucgaaggagauuucgacagcgaaaaucaguucgacacgagcauccaggcacucuucgaguaccuacgcgaagacauggaaguggacaucgacgcagacucccaaaaagucaaagaaauacuaaaagacagcucccucaaaaacuccgaaaaacaaucccgacugaauaaaauacugggguuaaaacccagcgacaagcaaaagaaagcaaucaccaaccucaucagcggcaauaaaauaaacuucgcagaucucuacgacaaccccgaccucaaggacgccgagaaaaacucuaucaguuucuccaaagacgacuucgacgcccuauccgacgauuuagccaguauccucggcgacuccuucgaacuccuacuaaaagccaaagcgguauacaacugcuccgucuuguccaagguaauaggcgacgaacaauaccucucguucgcgaaaguaaaaaucuacgaaaagcacaaaaccgaccucaccaaacuaaaagccguaauuaagaaacacuuccccaauaacuacaagaaagucuucggcuacaaccaagauaacgaaagcaaaaacaacuauucaggauacgucggcgugugcaaaacuaagaacaagaaauuaguaauaaacaacuccgucaaccaggaagacuucuacaaauuucucaaacccauccuuuccgcgaagucagaaaucaaggaagucaacgacauccuugcagaaauugaaaccgggaacuuccuccccaaacaaauuuccaaaucuaacgccgagauaccauaccaacuccgcaagauggagcuagagaaaauccuaagcaacgcggaaaaacacuucuccuuccugaaacaaaaagaugaaaaaggucucucccacucagagaaaaucauaaugcuccugacguucaaaauccccuacuacaucggcccuaucaacgauaaccacaagaaauccuuccccgacagaugcugggucgucaaaaaggaaaaauccccuucaggcaaaacuacuccauggaauuucuucgaucacaucgauaaggaaaagacagcugaagaguucaucacaucccgcaccaauuuuuguaccuaccuaaucggggaaucaguacugcccaaaaacucgcuccuuuauagcgaauacaccguccuaaacgaaaucaacaauuugcaaauaauaaucgacgguaaaaacaucugcgacaccaaacucaagcagaaaaucuaugaagaccuguuuaagaaauacaagaaaaucacccaaaaacaaauaagcacguucaucaaacacgaggggaucugcaauaaaacagacgaagucauuauacucggaauagacaaggagugcacauccucccugaaaucuuacaucgaacucaagaacaucuucggcaaacaaguugaugagaucucaacgaagaacaugcuggaagaaauuauacgaugggcaaccaucuaugacgaaggggagggcaaaacaauccuuaaaaccaaaaucaaggccgaguacggaaaauacuguuccgacgagcaaauuaaaaagauacucaaccucaaguucucagggugggggcgacucagccgaaaguuccuagaaacggucaccagcgagaugcccggcuucucagagccggucaacauaaucacagccaugcgcgaaacccagaacaaucucauggaacuacuuucaucugaguucaaauucacagaaaacauaaagaaaaucaacuccggcuucgaagacgccgaaaaacaauucagcuacgacggccuagucaagccccuauuccucucucccuccguaaagaaaaugcuguggcaaacucuaaaacuugucaaagaaaucucacacauaacacaggccccacccaagaaaaucuucauagaaauggcaaaaggugccgagcuggaaccagcacgcacgaaaacgcgccucaaaauacuccaagaccucuacagcuccugcaaaaacgacgcagacgccuucagcucagaaauccaguaccugucgggcaagauagagaacgaggacaaccugcgccuccggucggacaaacuguaccucuauuacacacaacucggcaaauguauguacuguggcaagccgauugaaauaggccacgucuucgacaccuccaacuacgacauugaccauauuuacccgcaaucaaaaauaaaggacgacuccaucuccaacagaguccucguaugcagcucaugcaacaaaaacaaggaagacaaguauccccuaaagucggagauccagagcaagcaacgcgguuucuggaauuuccuccaacggaacaacuucauaucgcuggaaaaacuuaaucgccucacacgcacaaccccgauaagcgacgacgagacggcgaaauucaucgcacgacaguuaguagagacccgacaggcaaccaaaguagcagccaaaguccucgagaaaauguuccccgaaacgaagauaguauacagcaaggccgaaaccgucucuauguucaggaacaaauucgacaucauuaagugcagagaaauaaacgacuuccaucaugcgcacgacgcguaucucaauaucguugugggcaacgucuacaacacaaaauucaccaacaacccguggaacuucaucaaggagaaaagggacaacccaaaaauugccgacaccuacaacuacuacaagguauucgacuacgacgucaaacgcaacaacauaaccgcaugggaaaaaggcaagaccaucaucacagucaaagauaugcuaaaacgaaacacucccauauacacacgccaggcagccugcaagaaaggcgagcuauucaaccaaacgauaaugaagaaaggccuuggacagcacccacuuaagaaagagggcccauuuagcaacauuagcaaauacggcggguauaauaaaguguccgcagcguacuauaccuuaauagaauaugaagaaaaaguaaacaaaauacggucucucgagaccauaccgcucuaccuaguaaaggacauucaaaaagaccaagacguccucaaguccuaucuaaccgaccuccucggcaagaaagaaaucaaaauccucgugccgaaaauaaaaaucaacagucuauuaaagauaaacggcuuucccugucauaucaccggaaaaacaggagacagcuucguucugcgcccagcaguacaauucugcugcuccaacgacgagguccucuacuucaagaaaaucaucagguucaacgagauacgaucccaacgcgagaaaaugggcaaaaccaucagcccguacgaagaccugagcuuccgcucauacauaaaggaaaacuuauguaaaaagacaaaagcggacgaaaucggagagaaggaguucuacgaucuucuccagaaaaagaaccucgaaauauacgacaugcuccucaccaaacacaaggacaccauauacaacaagcgccccaauucaaccacccucggcaugcucacaaaaggccgcuacgaguucauaaaccucaaaccuaaagaccagauuaucgucaugcuggaaauccucaaacuauucugcacgacccgcgaagcaaucgaccucggucucaucaaaggcaagcccgcugcaggcguagccacgcuugguaagaaaaucagcaaucuggacaauugcauccucaucuaccagucgauuacagggaucuucgaaaaacggauagaccuccuaaaaguguga

SEQ ID NO: 6754 - RNA, 4188 nt, Artificial Sequence
  Cas9 variant
augaagaaagaaaucaaggacuacuuccucggccucgacgugggcaccggaagcgucgggugggcugucacugacaccgauuacaaacuacucaaagcgaacaggaaagaccuguggggaaugcgaugcuucgagaccgcagaaaccgcagaagugcgacgccuucaccgcggcgcaagacguaggauagagcggcgcaagaaacgcaucaaacuccuccaggaacuauucagccaggaaaucgccaaaaucgaugaaggcuucuuccagcgaaugaaggaaucaccccuauacgccgaagacaagacaauccuccaagaaaauacacucuucaaugacaaggacuucacugacaaaaccuaucauaaggcguacccgacuauuaaccaccucaucaaggccuggauugagaacaaaguaaaaccugaccccaggcuccuauacuuggcaugccacaacauaauuaagaagcgaggccauuucuuauucgagggggacuuugauagugagaaccaguucgauaccuccauccaagcccuuuucgaauacuuacgagaagacauggaaguagacauugacgccgacucccagaaagucaaagaaauccuaaaagacuccucccucaagaacucugaaaaacaaucccgccuuaacaagaugcuaggccucaaaccaagcgauaaacaaaagaaagcuauaaccaaccucaucuccggcaacaaaauaaacuucgccgaccuguaugacaacccagaccuaaaagacgccgagaaaaauucgauuaguuucagcaaggacgacuuugacgcgcuuucggaugaccucgcaucaauacucggagauuccuucgaacuacuccucaaagcaaaagccguauauaacugcucaguacuaaguaaaguaauaggcgacgaacaauaccuaucguucgccaagguaaagauauacgaaaaacacaagaccgaccuaacgaaacuaaagaauguaaucaagaaacacuuccccaaagacuacaagaaaguauucggauacaacaaaaacgagaaaaacaacaacaacuacuccgguuacgugggcguuugcaaaaccaaauccaagaaacuaaucaucaacaacagcgucaaccaagaagacuucuacaaauuccuaaagaccauccuauccgccaaaagcgaaaucaaagaagugaacgacauccucaccgaaaucgaaacaggcacauuccuucccaaacagaucucaaaaagcaacgccgaaauccccuaccagcuaagaaaaauggagcuagagaagauacuaaguaaugccgaaaaacacuucuccuuccuuaaacaaaaagacgaaaagggacuaucacacucagagaaaaucauuaugcuccucacguucaaaauccccuacuauaucggccccaucaacgacaaccacaagaaauccuuucccgaucgaugcuggguagucaagaaagagaaaucacccuccggaaaaacaaccccguggaacuucuucgaccacaucgacaaagagaaaaccgcagaagaguucauaaccucccggacgaacuucugcacguacuuaaucggcgaaagcguccuacccaaaaacucgcuacuguacagcgaauauaccgucuugaacgaaauaaacaaccugcaaaucaucaucgacgggaagaacaucugcgacaccaagcuaaagcaaaagaucuacgaagaacucuucaagaaauauaagaaaaucacccaaaaacaaauaagcaccuuuaucaaacacgaaggcaucugcaacaaaacagacgaagugauuauccuaggcaucgacaaagagugcacgagcucguuaaagagcuacaucgaacucaagaacaucuucggaaagcagguagacgaaauaagcacgaaaaacaugcuagaagaaaucauacgcugggcaacuauauacgacgagggagaaggaaagacuauccugaaaaccaaaaucaaagccgaauacgguaaauauugcuccgaugaacaaaucaagaagauacuuaaccucaaauucagcgguuggggccgacugucgcggaaguuccucgagaccguaaccagugaaaugccaggauucuccgaaccagucaacauaaucaccgccaugcgugaaacucaaaacaaucuaauggagcuucugagcagcgaguucaaauucacggaaaauauaaagaagauaaacagcggcuucgaagacgucgaaaaacaguucucauacgauggacuggucaaaccacucuuucuaucaccgagcguuaagaaaaugcuguggcaaacccucaagcuaguaaaagaaaucucccacaucacccaagcaccgcccaagaaaaucuucauugagauggccaaaggagcggagcucgacccaguccgaaccaaaacgcgacuaaaaauccuucaagaucuguauaacaacugcaaaaacgacgcagacgcauucuccagcgaaaucaaagaucucucgggcaaaauagagaacgaggacaaccuccgccuccgcagcgauaaacucuaccuguacuacacacaacucggaaaaugcauguacugcggcaagcccauagaaaucggacacguauucgacaccuccaacuacgauauagaccacauauacccccagucaaaaaucaaggacgacucaaucucaaacagggugcucguaugcagcucauguaacaaaaacaaggaagacaaguacccucucaaagccgagauccagaguaaacaaaggggguucuggaacuuccuccaaaggaacaacuucaucucgcuagagaaguucaacagacucacccgcgcaacccccaucuccgaugacgagacagcuaaguuuaucgcacgucagcucguggagacucgccaagcuaccaaagucgccgcuagaguccuagagaagauguucccagaaaccaaaaucgucuacuccaaggcagagaccguauccauguuccgcaauaaauucgacaucgucaaaugccgagaaaucaacgauuuucaccacgcccaugaugccuaccugaauauaguagucggcaacgucuacaacaccaaguucacgaacaaccuauggaacuucauaaaagaaaaacgcgacaacccaaagaucgcagacacguacaacuacuauaaagucuucgacuacgacgucaagcguaauaauaucaccgccugggagaaaggcaagaccauaaucacugucaaagacaugcucaagcgaaacacacccaucuacacucggcaagccgcgugcaagaaagggggacuauucgaucaaacaauaaugaagaagggccucggccagcauccacuaaagaaagaaggaccguucuccaacauaucaaaauacggaggauacaacaaagucucagcagcguacuacacccuuaucgaguaugaggagaagggcaacaaaauccgcagccuggagacaauaccgcucuaccucgugaaagacauccagaaagaccaagacguccuaaaauccuaccuuaccgaccuucuagggaagaaggaguucaaaauucuggugcccaaaaucaagaucaacagccuacuaaaaaucaacgguuuccccugccacaucaccggcaaaacgaacgacuccuuccuccuccgccccgccgugcaguucuguugcucuaacgacgaagugcucuacuucaagaaaaucauccguuucagugagauccgcucccagcgcgagaaaauaggaaaaacuaucuccccauaugaggaucucagcuucaggagcuauaucaaagagaaccuaugcaaaaagaccaagaacgacgaaauaggcgagaaggaguucuacgacuuacuucaaaagaagaauuuagaaaucuacgacaugcuccuuaccaagcacaaggacaccaucuacaagaaacggccaaauucagcgacgaucgacauacucgucaaaggcaaagaaaaauucaaaucgcugauaaucgaaaaccaauucgaagucauacucgagauccucaaacuauucagugccacccgcaacguaagcgaccuacagcacauaggcggcuccaaauacuccggagucgccaaaaucggcaacaaaaucagcagccuagacaacuguauacuuaucuaccaaucaauuacaggcauauuugagaagcgaauugaccuccuaaaaguguga

SEQ ID NO: 6755 - RNA, 4191 nt, Artificial Sequence
  Cas9 variant
auggacuccucgaaacaaggccuacgacgcuaccaccucggccuagacauugggaccaacagcaucggcuggacugccauagacgaccacuucucccuucuccgcgucaagggcaaaaacgccauaggaguccgcaccuuuaaagaaggcgaaacagccgcagaucgccgcggguucagaaccgcccgccgccgccuuagccgcaggcgcuggcgacuccaauuucuggaugaguucuuugcacccuaccuggcagaagucgacccuaacuucuuagcccgacucaaacaaucagacauuuccgcuaaggaccccgccaaaaaccaagaauacaugggaaagcuacucuucccggaccaagaagccgccucagacgggaauggauacccaacucuaauccaaaugcguaaagcaaugcccgccgaaaaagcggcagacuuccccguguuuaacauauaccaacuuagguacgcguugaugaacgaaaagcgaaaauucgaccuccgugagaucuaccuagcgguccaccacaucguaaaauaccgcggcaacuuccucaacaacacuucggucgauaaguucaaggcagaccagaucgacuucaacaaaucauuugaaacccuaaacgauuuguuccgccagguacaacccaucgcgccauuccaaauagaccucacaaaagucgacgaacugggcaaacugcuccuagacacuaaacaaaagaaacucgaccgccaaaaggccguagccaaacuacuaccucuaaucgaagauggaaccgacaaagagauaguuaaagcucaccaacaaacggcacgcgaaaucuccaaacucauccuaggauacaaagccaaaguaggacuaauccugcaaaacaaccucgaccaaacccuugacauguccaccgagaacuccgacgaccaacuaaugcagaucgcagaggaacuagacgauuaccaaauggaacugauaaaucaguugucccuacuauacagccaaauaaugcucaacgaaauaguccccaacggcgaaaccguaucagccuccaugcugaaccgauacuauaagcaccgaugccaacugaaagaacuaaaagacuacggugcagcccaggacaagaaaacucgagagcaacucgaccaccucuacgccgaauacaucggccagauaccaaaagauuccaaauucgauuucaccaaagaucugaaaaagcuaauggauaaaucagaccucggccaaaagaucaaagacgagaucgaagccggugacuaccucccgaaacagcguaccagugccaauggaguaaucccccaccaaaugcaccaacaggaacuagaucaaaucauagaaaaucaaaaagaauacuaccccugguuagcugaacccaacccagucgagaaaaacaucaagaacgcaaaguacaaacuggaccagcuagugagcuuccguguaccauacuacgucggcccaaugaucacacuagccgaccaacagaaaacaagcaaagccuccuucgccugggccguccgaaagaaagcgggaaaaaucaccccauggaacuucuaugacaugaucgaccgagaaaagucagcgaacaacuuuauaaagcgcaugacaaauaaagacacauaccugcucagcgaagacguccuacccgccagcagcuuacucuaccaaaaguuuacgguccuaaaugaacuaaacaacauacguguaaaugguagaaaacugcaaccggcacucaaacaagccauauauacagaccucuuucaaaaacggaaaacaguaaaccucaaaacccucacgaacuuccucgcgauacacgaaccaacacucacaaaacccaaaauugaaggucuauccaacggcagauccuucaauucaucucuaggcacauacauagacaugucaaagauacucggugacucacuggacgaccucaauuacagagacgacaucgaaaagaucaucgaguggagcacgguguucgaagacuccgagaucuacggggugaaacugcaagaaauccaauggcuaacaaacgagcaacgggaaaaacucguacgaaaacgauaccaagguuggggccggcuaagcaagaaacuccucacgggaauaacagaugaaaacggccaaagaauaaucgacuuaaugugggacacguccaaaaacuucaugcaaauaguacaucaaccgguauucgaggaacaaaucgcagagcucaaucaacagcugcuccaagaugccgacaaagcaccgcuugaagugguagaugacauccuagcagacgcguauacaucaccccagaacaagaaagcgauacgccagguggucaaaguuguggccgacgucgucaaagcagucgguaaugcgccggccucaaucucgauagaguucgcgcgcaaugaagaccgcaacaaagaacucaagaacucccgacggcacagcaucgagaaguuauaucacgaaacagcugaaaaauuggugaaacaaaccaaccuacucgaggaacuaggcaacguaaaagaccugaacgaccgcuacuacuuguacuucacacaagcaggacgagacauguacgauggaacccccaucaauaucgacgaaaucagcacacacuaugagaucgaccacauacuaccgcaauccuuccucaaggacaacucccucgacaaccgcgugcuagucaagaaauccgaaaaugccgcaaaaagugaccgggucccugccaaacuauauggugccaagaugcgggcuuucuggaagcagcuuaaagagagccaacucaucaguaaccgcaaauaccuuaaccuaacgaccgauccugaacaaguugacaaauaucagaugcaaggauucguacaccgacaacucgucgaaacaagacaaaucauaaaacuagccgcgaacaucuuuggcucccucuacccggacuccgcggucaucgagaccagagcggaacuaaccaagcagcuacgcgagaaguucucgcuauacaaaguacgggacguaaacgacuaccaccacgccguugacgcguaccucaccgccuucgccgggcacuaucucuaccaacgguauccaaagcugcgacccauguuugucuacggcgacuacgccaaaaucuaugcugaugaucuaaagagacuccgcagcguaaacuuauuccacgaccuagaaaaggaccaauauaacucaggcacugcgguaaacccggaaacaaaagagaagaucgucgauguagacuggcuuuccgacuacguguccaagauucagcacuucaaguacaugcugauauccaaagccguauacacccagcacgggcaacuauacggggcaacaauccucccggucgcccaagucgacaagauauccgcacccauuggcaucaaagacgacaaaccuguggacauuuauggugcauacaccaacgaggucgccgcuuacauggccaucguaagagucaaugggaagaaacccaaauacaaagugguaucagucccagucagaaugcuacaaaggcucaaaauggcagaacaaaagggccacgaccaguacaugcaaacccuccacgacguacuccuacgcaauuucacgucgcuaaagaagaaccgaaaaacgggccucaaggaggccguagucaaagacuucgacguccugguuccaugcguccgauacaaccaacucgucauugacggcgacaccaaguucacccuagguuccgccaccuaccagcacaacgccaagcaauuaguuuuaugcaaccacucccucgaaacccuagccaacaacuucgaauacguucgcaaacaccccgaugaggccgacgaacgaaugaucaugcuauacgacgacauacuggaccaaguaaaccacuacuucacgcuguacgacaaaaacaaauuucgcgaaaaacucaacgcaggccgcgauaaguaccucaaacucccaaccuucagccaauucgaaaacaacaaaaagacggcaauagggaaaagcgaagcgaucaucaacauacuacgugguuuacaugccaacgcggccauaaccaaccugaaaugccucggcgucucuaccccuuucggucaacuacagucccccucagggaucgaacugagcgagaacgcgaagcucguguaccaaucuccgaccggccuauucucccgcgaaguucugcucaaagaccucuga

SEQ ID NO: 6756 - RNA, 4191 nt, Artificial Sequence
  Cas9 variant
auggcaaaucuccgcaauuacaagggcgacuauaacaucggccuagacauggggacagguagcgucgguugggcggugacggauagcgaaggaaaacuccugcacuucaagaaacaacccaccuggggcucaagacucuucgacagugccgaaaccgcagccagugcccgcauuccacgaggccagaggagaagauauguaagaagacgguggagacuugaccugcuacaacaacucuuccaggaugaggugucaaaggcggaccccgaguucuucauccgacuccgacaaagcagacugcucaaggaagaccgugaagaaggacauagagacuauaaccacccccucuuuaacgacuccgauuucacagaaaccgacuacuacaaccgguucccaacaauuuaccaucugcgaaaauggcuaauggagacagacgaaaaagccgacauaagacucguauaccuagcagcucacaacauuguaaaacaccggggcaauuuccugcgccaggaaaacacuucccuauccgcgaaaaaugcacggccguuagacgcacucagagaguuccgcuccgcccuagucgauuggugcgccgaauuggguuacgaauguaaccccgacgaaagcggcgaaauaaguaacgaaauccuaucaguucucgaagaagaacacguggccaacucagacaaaaagaaaagaaucagcagucugauaggcgucgcaaugaaugagggagcaaaagaaucgaaggcaugcaacgaugcguuagcaggagccauggugggacuaaaggcggaguucaaaaacguauucggcgaaaucagcgcagaacagaccuccaucuaccuaagcaacgacgaggccguagacgcucucagagaaggaauccccgacgaaggccucgaacucuucggaaagcucugcagcguguauagcgcguauguacuacaagggcuacuaagcuaugcccccggccaaacaauaucagugaacauggucgcuaaauacgaaaaguacgggaacgaccucaaaacacucaaggcccugguaugcgaauacgcaagggccgaauaugacucguucuuuaggggagaguucuaccgcgaccaagacggacacgaacugaacaucuauaacgcgagcaaggcacaaggguauacgcguuacaaccuggggacgagcaaaaugucguacgaggacuucgaaaaagccguaaagaaacuguucgccggaacggcagccgaggaagacggucgauaccuacaaaugaugaaagaguucggagagcagagauuccuaagaagacuaaaaacauccgauaacgggucgaucuacuaccaacugcaucucgaagaacuuacggcaauccuuagcaaccaaggaaaacacuaccccuuccucguagaagacgcagagaaaauuaagucgcuagucuccuucagaauaccguacuacgucgggccacucacagaccgaaacgcccgaaaggacaaacacggcaagaauagguucgcauggagcgaaagaaagucgggaauggaagacgcuguaauuacccccuggaacugggacgaaguuaucgaccgaggaaaaagcgccgaagcguucaucacccgcaugacagggaugugcacauacuuacaaggcgaagaugugcuaccaaaaugcagucucuuauacgaagaguucugcguucuaaaugaacucaaugggagccgauggggcauggacggcgacaaggaacaucgcuucgacgcagccgaccgagaagcaauuauugaagaacucuucaagaaaaagaaaacaguaaaauacaaagacgucgccaacugguuggaaagagaagccgggagaaugaacguucacgucaugggcggccagggcgaaacgggauacgaaucaaaacuaagcaguuacuacuucuucagacgcgauauauucgaugucgaggaacuagaccgagcggacuauccaaugaucgagcaaauaauacucuggaacacccuguucgaagaccggagaauacucaaagaaaaacuggaggaugcauacggaccaaaaggaaacggcagacuggacgacgaccaaaucaaaaagauaugccgaaaacguuucacaggcuggggccgacucucaaagaaauuccucacaggcauaaaggucgacacagauugcggcccccguucaauaauggauguccuaagagaaggagacccaaacgccggcuuccgagguaaaaccauggucaugauggagguccuacgagacgaaaacuuggguuuucagcaaaaagucgacgaguucaacaaaaacuacuucgggcaaaaaggaaaagcgcucgaaguaaaugaacucccagguagccccgcaauccggaggagccucaaccaggccauacggauagucgaugaaauagcaaaaaucgcgggaaaagacccagaaucaaucuucaucgaaguaacaagggaugacgaacuggacaaaagggguaagcgcaccaagagacgauacgacgcccugaaggaggcguuaacagucuuuaaaaaggaggauccggagaucugggcagaacuccaagccaccagcccgagcgaccucgacgaaaggcucacccuuuauuucaugcaaaggggaaagugccucuacagcggagagccaaucgacaucaauaaacuuucaucgggcgaauaugaaguagaucacauaauaccacgcucguacauaaaagacgacucucuagaaaacaaagcgcucguuuguagaaaguauaaccaguccaagacagacgccaugcuccucgacccgucgauacgcaggaaaaugcgaucauacugggacaugcucuuagacgcaaaauugaucgggcccaagaagcaccggaaccugcuccgagaccacaucgacgaaaaagcaaugaaaggcuucguagcccgacagcuagucgaaacaucacagaguguuaagcucgcuggcagccuacucagcguccgguacccgaacgccaacauagucccaguaaaggccagcaugagccacgaucuccgagaagccgcaggauucguaaaaugcagagaagccaacgacuuccaccaugcgcacgacgccuaccuagcaugccggauggggcuauuuauacaaaugaggcaccccaaaguguacgaaaacccaauagcaaugacccgagucaugcaaaaauacgcccaacaacagucaaaagaguucaaccgcaaccaccgaguccccgggacaagcggcuuuaucgucaauucuuucaugaguagcggauucgacaaagaaaccggagaaauauucaaagacaccuggaaugcagaaacagaaauagaaggaauacgcaaagcgcugaauuacagacagugcuacaucagcagaaugccaauggaagauacgggggcguucuggaacgccacaguauacucccccagagaccccaaaauggggccgaaauuggcccugccgcuaaagaaagggcuggaccccaaaaaguacggaggauuuucgucgcagcaguuugcauauuucuucgucuacgaagcacgggacaagaaggacaaacagguguuccgcuucgcagaagugccagucuggcuagcgucgcagauagagagcgacaagaucgccuuggaacgcuacgcaacgggacuagccgaagcagagaagcuaaaauucgugagaaucgagcgugcaaaaaucuuaaagaaacagcucaucgaaauagacggagaccgauuuauacugacgggaaagaaagaaaugagaaacggcagggagcucgcccugucacaaaaagaaacacuuaaccucauagucgccggagaugagaacgcgagcuuagacgaccgaggaaacgcuucggacgcgguauucgacgcgaucguucgacagggcgacgagauaggacuacgccuguauaaacagcuaaaaaucgcagaaauagcagagagauaccgcucggugggugcagaugccaaagucggggcggugaugagucuccuaagcucaauuaacgccagcagcaacauggugaaccuaucuaugguaggcggcagcaaauacgccggcaacuuacagccaaauuacagcaaucuccuuucagaccccgagacaaacuucgugauaauagaccagagcguaacaggcauguucgaacgccgaacaaggauagggcuauga

SEQ ID NO: 6757 - RNA, 4191 nt, Artificial Sequence
  Cas9 variant
augaccaagccguacaguauaggacucgacaucggcaccaacucagucggcugggccguaaucaccgacgacuacaaagugccugcaaagaaaaugaaaguacugggcaacaccaaccgugacuacaucaagaaaaaucuacucggagccuuacucuucgauggcggcgaaaccgcagaaggacggaggcuaaaacguacagcgagacgacgcuacacgcggcgcaaaaaucgccugcgguaucugcaggaaauauucgccgaagagaugaugcaaguugacgaaucauucuuccagcggcucgacgacagcuuccuagucgaagaagacaaacagggaagcaaauaccccaucuucggaacccucaaggaagagaaagaauaucacaagaaauucaaaacaaucuaccaccuccgcgaggaacuggccaacuccaaagagaaagccgacuugcgucucguauaccuagcccucgcgcacaugauuaaguucagagggcacuuccuuuaugagggggaucuaaaagcagaaaacaccgacguccaagcgcuauucaaagacuucguagaagaauacgauaagacgauagaagagagccaccuaagcgaaauuacagucgacgcccuaucaauccuuacggaaaaggucaguaaaagcagccgccucgagaacuuaauagcccacuaccccacggagaaaaagaacaccuuauucgggaaccucaucgcccuaucccugggccuccaggccaacuucaaaaccaacuuccaacucagcgaagacgccaaguuacaguucucgaaagauaccuacgaagaggaccucgagggccuacuaggcgaaguaggggacgaauacgcagaccuauucgugagcgccaaaaaucuauaugacgcaauccuacucucuggaauacuuacaguagacgacaacagcaccaaagcaccccuauccgcgucgauggucaaacgcuacaaggaacacaaagaggaacuggcggcauucaaacgcuucaucaaagaaaagcugcccaagaaauacgaagagauauuuaaagacgacacuaaaaacggcuacgcgggcuacgucggcgcagacaagaaacuccgcaaacgcuccggaaaacuagccaccgaagaagaguucuacaaauacgucaaaggcauacucaacaaagucgaaggggcggacuacuuccuugacaaaauagaccgggaagacuuccuacgcaaacaaagaacuuucgauaacggcucgauaccacaccaaauucaccuccaagaaaugcacgcaauacucaggagacaaggggaacacuaccccuuccucaaggaaaaucaggacaaaaucgaaaagauacucacguuuagaauccccuacuacguaggcccccuggcccgaaaaggcagccgauucgccugggccgaauacaaagccgacgagaaaaucacgccauggaacuucgacgacauacucgacaaagaaaagagcgcagaaaaauuuaucacaagaaugacacugaaugaucuuuaccuacccgaagaaaaagugcuaccgaaacauagcccccuauacgagacguucacaguauacaacgaauugaccaaggucaaguacgucaacgagcaaggggaagcgaaauucuucgacacaaacaugaaacaggagaucuucgaccacguauucaaggaaaaucgcaaaguaacgaaagacaaacugcucaacuaccucaacaaggaguucgaagaauuucggauaguaaacuuaaccgggcucgacaaagagaacaaggcauucaacgccucccucggaaccuaccacgaccucagaaaaauacuagauaagagcuuucuggacgacaaaguuaacgagaaaaucaucgaagauaucauccaaacccugacccuuuucgaagacagagaaaugauccgccaacgucuucaaaaguacucagacauauucacuacccaacaacuaaaggaacucgaaagaagacacuacacaggauggggaagacuaucguacaaacucaucaacggcauccgcaacaaagaaaacaagaaaaccauucuagauuacuuaaucgacgacggcuacgccaacagaaacuucaugcaauugaucaacgaugacgcacuauccuucaaagaagagauagcccgggcacaaauaaucggcgacguggaugacauagcaaauguagugcacgaccucccaggauccccggcgaucaagaaaggcauccuccaaucggucaaaauaguugacgaacuuguaaaaguaauggggcauaacccaaccaacauaaucauagaaauggcccgcgagaaucaaaccacggacaaaggccgccguaacucgcaacagcgacucaagcuccuacaggacagucugaaaaaccuagacaacccagucaacaucaaaaacgucgaaaaccaacaacuccagaacgacaggcuauuucuauacuacauacagaacgguaaagacauguacacgggcgagacucucgacaucaacaaccucagccaauacgacaucgaccacauaaucccucaggccuuuauuaaagauaacucgcuggacaaccgcguuuugacccgcagcgacaaaaacagagggaagagugacgacguacccuccauagaaguaguccacgagaugaaguccuucuggagcaaauugcucucaguaaagcugauaacacagcgaaaguucgacaaccucaccaaggccgaacgaggaggacugacagaaaacgacaaagccggauucauuaaacgccaacucguagagacccgccaaaucaccaagcacguagcgcaaguacucgacgcgcgcuucaacgccaaacaugacgaaaacaagaaaguaauccgagaugucaaaaucauaacacucaaaagcaaccuugucagccaauuucgaaaggacuucaaauucuauaagguacgcgagauaaacgauuaccaccaugcccacgacgccuacuugaacgccgucauaggcacggcucuccucaagaaauaccccaaacucgcaagcgaguucgucuacggagaguucaagaaauacgacgucagaaaauucaucgcgaaaagcgacaaagaaauugggaaggcuacggcgaaauacuucuucuacuccaaucuuaugaacuucuucaagaaagaggucaaguucgcagacggcacagucguagaacgcccggauaucgaaacuucagaagacggcgaaaucgccuggaacaaacaaaccgacuucaagauaguccgaaaaguacugucauacccacaggucaacaucgucaagaagacagagguccagacacacggacuagacaggggaaaacccagagguuuguucaacgccaaccccucaccgaaaccgaaacccgacagcucggagaaccuaguuggcauaaaaaggaaccuagauccgaaaaaguacgggggcuacgcaggaaucucgaacuccuacgcgguccucgugaaagccaucauagaaaaggguguaaagaagaaagaaacaaugguccucgaguuccaaggcaucucuauccucgaccguauaaccuucgaaaaagacaaacgagccuuccuauuggguaaaggcuacaaggacauaaagaaaaucaucgaacuuccaaaauacagccuauucgaauuaaaggacggcucccgccggaugcucgccuccauacucuccacuaacaacaagcgaggcgagauacacaaggggaacgaacuauucgucccccaaaaguuuaccacauugcuauaccaugcgaagcguauaaacaaccccaucaacaaagaccacaucgaauacgucaagaaacaccgagacgacuuuaaagagcugcugaacuauguucucgaguucaacgaaaaauacgucggcgcaacaaagaacggcgaacggcucaaagaagccguggccgauuucgauagcaagagcaacgaagagauaugcacuagcuuccugggcgccgugaacuccaaaaacgcgggacucuucgaacucacaagccuaggauccgccagcgacuuugaguuccuuggaguaaaaauuccuagauaccgcgauuacacgccuuccucacuccuaaaagacucgauucuaauacaccaguccaucacgggguuauaugaaacccgcauugaccuaagcaagcuaggugaagacuga

SEQ ID NO: 6758 - RNA, 4191 nt, Artificial Sequence
  Cas9 variant
augaagcgcguaaacgaggacuacauccucggacuagacaucgggacaaauuccugcgggugggcugugacagacaagaaaaacaacuuacuuaaacucagggguaaaacagccauagguucgcaccuauuugaagaggggcacacggccgccgacagacgaggauuccgaaccacgcgccgacgccugaaacgacgaaaauggcgccugcgacuccuagaggaaaucuuugcggaacccauggccaaaguugaccccggcuucuucguccgccuccaccaauccuggguuagcccgcucgacaaggaccgcaagaaauauaacgccaucguauuccccaccgccaaagaggaucaagcguuuuacaaacacuacgcaacaauauaccaucuccgugacgaacuaaugacccaggaccggcaauucgaccuaagagagaucuuccuggccauccaccacaucguaaaauacagaggcaauuuucugcaagacacaccaguaaaggacuucgaagccucuaagaucgaagucggcccaaucuugucgcacaucaacaacgcauucgcggagaagaucguugaggaccaggauccgaucgaacugaauguugcaaacgcggccgacaucgaagaugugauacgaggcaaggacgcagaaaagacaguuuacaaacucgacaaggucaagaaaaucgcgaaacugcucacagacuccaccgcuaaggaggagaaaaacgucgccaaacaaauagcgaacgcaaucaugggcuacaaaacgcaguucgaaacgauacuagacaaagaaauagacaagucagacaaagcgcaaugggaguucaaacugagcgacgcugaugccgacgauaaacuagacgcccugcucccggaccuggaugaaaccgaccaaacaguaguagcagaaauagaaaaacucuucagugcaaucacacucuccacgauagucgacgagaacaaaagccucagucaaagcauggucgaaaaguacaagaaacacaaaaaggauuacaagaagcucaagaaauacauaaacacgcuacaggaucagaccaaggccaagaaacuucuacuggccuaugaccuguacgucaacaaccgacauggccggcuccucgaggccaagaaaacauucgaagauaaaaagaagaagaaagcacuaacaaaagacgaguucuacaaaauagugaaagacaaucucgacgauuccgaccuagcccacgaaauccaacaagaaaucgccgcagacaacuucaugcccaaacaacgcacuaacucgaacggugugauuccauuccaauugcaccaaaucgaacucgacaaaaucauagcgaaccaaggaaaauacuaccccuuccucgcggccgaaaaccccguagaggaccaccgaaaacaggcaccauacaaauuagacgagcucguccgcuucagagucccauauuacguaggcccaaugaucaccgcagacgaacaagagaaaacguccgggaaauccuucgcauggaugguccggaaagaagacgggcaaaucaccccauggaacuuugaacagaaggucgacagacaagaaucugcaaacaaguucaucaaaaggaugaccaucaaggacaccuaccuccucagcgaagacguucucccagcgaacaguuuacuuuaccaacgauucgaaguccucaacgaacucaacaacauccggaucaacggcagccgcauuuccgucgaccuaaaacaacagaucuucaacgacuuauucgaagagaagaaaaccgucaccgagaagucccugacuuccuaccuaaaacaaaaccuccaccuacccacaguagaaaucaaaggccucgccgaccccaccaaauucaacaguucccuggccagcuauuaccaucucaaaagccugcacguguucgacaaagaacucgcagacccccaauaccaaaaagacuucgagaaaauaaucgaauacucuuccauauucgaagacaagaaaauauuccaggauaaacugcacgccgaguucaaauggcugacaccagaacaauucaaagcaauuucaacauggcgccugcaagguuggggccgccucagcaggaaacuccucgucgaacuacacgacacaaauggacaaaacaucauggaacagcuuugggacagccaaaagaacuucaugcagauugugacagaacccgauuucaaagacgcgauagcaaaagaaaaccagaacgugacucgggccaacggagucgaagaaauccuugcagacgccuacaccagcccagccaauaagaaagccauacgacaggucguaaaaguagucgccgauguaguaaaagccgcgggcgggaagaaaccugcgcaauucgcuaucgaguucacaagggaccccgacaaaaacccccaacugucacacauacgagggacgaaacuccucaaggcuuaccaagaaaccgcgggagaacucguagaccagaaacugaccgacucacucaaagaggccaugaccagucgaaaacuacuuaaagacaaauacuuccuauacuucaugcaagcaggcagggacgccuacacaggacaaaagaucaacaucgacgaaguaucaaccaacuaccagauagaccacauccuaccccaauccuucaucaaggacgacucauucgacaaccgaguccuaacagcaaccccacugaacgcggagaaaagcgacgaugucccuuauaagcgauucgcaaauaacuacguauccgacaugaagaugacaguuggcgaaauguggaagcacuggcagaaggccggaaucaucaacaaacacaaacuaggcaaccuccuccuagaccccgacagacucaacaaauuccaaaagucaggguucauaaaccgacaacuggucgagaccagccaaaucaucaaacucgugucagucauacuccaaaacaaauacccagacgcagaaauuauaaccgucaaagcaggcgacaacucagccuuaagacaacgacugaaccuauacaagucaagggacguaaaugauuaccaccacgccaucgacgccuaccuguccaucauuugcggcaacuuccuguaucaagucuacccgaaauaccgcccguacuucguuuacgguaaguacaagaaauucucacaagaccccgaccuccaaaaagaagugaucaaacacuucaaaggcuucacauuuauguggccgcuacuccaaaaagacaacuccgaacgcaaggcaccugagaaaaucaaggagaauaacuccgaccgcaucgucuucuacaaacauccggauauauucgauaagcugcgaaaggcguacaacuacaaauacaugcuggucucgagagagaccacgacagaaaacaguggguuauucgacguaacaaucuacccccgcggagaacgagaccuugcaaaaacgcgcaaacucaucccgaaguccaacggacucgaccccaaaauauacggaggguacagcggcaacacagacgccuacauggugauaguaaaaaucgauaaaggcaaggaaucaaucuacaaaguaaucggcgucccaaugagagcauuagcaucacugaaccgagcaaagaaacaagggaacuacaaagaagaacuccaucaagucuuggagccgcaaauuauguucgauaaaaacggcaaaccaaaaagguccgucaagggauuucgcaucaucaaagaccacguacccuucaaacaagucguccuggauggcgauaagaaauucaugcugaauaguaguacguacgaaauaaacgccaaacagcucacacucaccccagaaacuaugcggauaguaaccgauaaccucaagaaaggugaagaccaggaucaacuacuuguaaaagccuacgacgaaauccuucaaaaaguggaccaauaccuaccccucuuugacgucaacaaauuccguaacucacuacaccugggccgcgcaaaauuccucgaccucgcagucaacgacaagaaaauaacccucacaaacauccugaacggccuacaugacaaccucgugacacccgaccuuaagaacauagguauuaaaacaccccuaggcaaacuccaaguaccgagcgggaucguacucagcucagaggcaauccugaucuuccaaagcccgaccggucucuucgaaaaacgcgugaggaucgcagaccuauga

SEQ ID NO: 6759 - RNA, 4194 nt, Artificial Sequence
  Cas9 variant
augaaagacuacaacaucggccuugacauaggaaccuccuccauaggauucgccgcaauagacgaugacaauaaccugauccgcguaaaaggcaagaacgugauaggcagucgucucuucgcagaaggcaagacagccgcugaacgucgugguuuccgcaccgcccggagacgcuacaaccgccgaaaguggcgacuaaaacuacucgacgagaucuucuacgaggaaaucauacauaucgaccccgaguucuucaaucgacucaagcaauccagcaucucccccaaagaugaauccaagaaauacuucggcucacuacucuuccccgacaaaaccgauucagccuauuaccacgaugggaaccaaaccaucuaccaucugcggaaucgauuaguucaccagaaagaaaaagccgacauacgcgagaucuaccuggcccugcgccacaucguaaaauaccgcgggaacuuccucgacagcacccccgucuccucauucgaagccgauaaccugaaacuggacgagcuggucccggucauaaacgacauguacgagaacaucgacauagacuucucaaucaacguggacaacaucagcgagaucgagaaaguccuccucgacaaccacuugaaauccgcggacaaacaggaccgccucaaagaacuucucuacgacaacccggaauaccccgacgacaaaguaaaacaaaaagagaucagcaaguuucgcaaggaccuggacaaagagaucaucaaaguaauagucgguuauaaauuuaacgcauacaagaucguaaacuacaucccagacgacggauccaaguucuccuucagcuucuccgacgaaagcuccgacgauaaacucgacgaccucucagaaguccuagaugacucacagauggagauucuaaacacucucaaggugaucuacagcagaguccggcugaaccaaauaauaccaaacgguaugggccugagcgaaucgaugguggcgaaguacaaccgccaccacgagcaacuagaagaccuaaaagaacuccucgacguacucccgaacgacgaaaagcgcagcauagaauacgcguacacagccuacauagggaacguggacaaacagaaauacaauaacaaccuugucgcgucgcucaaggaccucccgauaaaaggcgauauaaacaagaaaauccaagccguauuugaguacgcgaaaggucacaucagcucacaggacuuauacgacgugaucaagacaaucaucauagacaaauaccucgaagacgagagcuuugaguaccacgaccuagucgagaggauauccaacgacaucgacaacaaagacuaucuccuaaagcagcgcagcagucaaaacgguaauauuccccaccaggugcaccagauggagauggauaaaauaaucgccaaucaaucccaguacuauccuuuccucggaguccucaacccgaacgaaagccgacgccauaucgcaaaguacaagauuagugagcuagucucuuuccgaguacccuacuacgucggcccccuaauaacccccgaagaacaagagaaaacgagcggaaagcacuucgcauggaugaaacgaaaagaagccggaaagauaacccccuggaacuuugaagagaaggucgacaaagaagccacugccgcaaaguucaucaaacggcugacaguaaaagacaccuaccuccuaaacgaagacguacucccggauaacucacuacucuaccaacaauucaaaguccugaacgaacucaacaucguaaaagucaauaacaagcgacucacccuauccgaaaaacaaggcgucuacaacgaccucuucaagaacaccaagucuauaacgguaaaaagacuuaagaacuaccucaucucuaacuacaaacaccucgaaaacaucgaaauaacgggccuuucggacggugacaaauucaacaauagucucggaacuuacaacgacuucaagaagaucuucggcgcgcgaaucgacgacguaaacuauagcgccgacuucgagaacaucaucgaguggagcaccguauucgaagaccgcuccauccucaaggaaaaacuagagaaagacaucgacuggauaaccccagaagaaaucaaggccguaguagccaagcgguacagcggcuggggccggcucagcgccaagcuccugacugaacuucuggacgaugacggacagcgcaucaucgacauccuguggaacgauuccaucacuuucauggaggcuguauccaaaccagaaaucaaagcacaaauccaaaacauaaaccgugacuuuaucaaggccaccgacaucgaaacuguccuagacgaagccuacaccuccccacagaauaagaaagcuauucgcgaggucuacaagcuaguaaaagacauacaaaaagcaaugggaggcaaagccccaucuucaauuagcauugaguucacacgaucgcccgaagacaauggcagcguaaccaaaacccgauacaacaacaugcagaacaaauacaaagaacuugguaaagaacuaagugacgaccucagcgcgcaacucaaagaauacaaaggcagaauggaccaagacaaguucuaccucuauuuuaugcagaugggaaaagaccuauacgacggcagcaccaucaaccuugacgaccucaacucauaccagauagaccauauaguaccccaguccuucuauaaggacgauagcaucgauaaccguguacucacacacuacacaaacaaccagaagaaaggaaaccauaccccucucaacggccuaaauauugacgcccagacccagaaucuauggaaacaccucaacaaacuaggccuaaucagcaagaaaaagcuccaaaaccuaugcuuuaaagacaucaaucagcucucuaaguacacgaaacacggcuucgugagacgccagcugguagagaccucccaggucauaaagcugguagcaaacauccucagcgaugaguucgccaacgaugggacaaagaucauagaagucaaagcuaaaaugaacucgcucaugcgcgacacauuuaaucuauacaaggugcggcaacucaaugacuaccaccaugccgucgacgccuaccucaccacauuugugggcaaauaccucuacaaacgcuacccaaaacuucgauccauguucguguacggagacuucaagaaauucuccgccgaagacgaccucaaagauaucaaaacauucaauuuccuccacgacauaacaaaucccaaagaaagcaacaaagagaaaauauacgacgagaaaagcggcgaacuaauccucgacagaaaacacgccauagaaacaaucaagaaaauauaccaauacaaauucaugcucaucguaagggaagucucgaccaaaagcggacaacucuucaaacaaaccauuuacuccgcgaagaaaaccaacggacucaaaagcgccaucccagucaaguccaaccucgaacccagcaucuacgguuaccgauccgguaacguggaccaccacaugguaaucgugaaaauaaagaaagggacgaaauacucuuucaaagucauagggauaagcgcccgggccauacaagaauuagagaucgccaaaaagaucgguaacuaucgugauaaacuguacgaaguagucucagacaggcuuagccaauccaugaaaucggucgagagcuuccgaauaauacucgauaacauaauguacggucaacuuaucguagacggaaacgacaaguucacgcuugggagcgcagacuaccgaaagaacucacgccaauuaguccuaugcaccaacagccuaaaaauacugaaggacgaagacuacaugaaccgccucuccgacauacaacgaucuaaauugaugguucaagucuacgaugaaaucaucaaaauuaugaaaaacaaguacucccucuucaucucgaauaccgaaaaacuccuggaaaagcgcgauaucuucugcggccuuucguucgaugagcagaaaaucgucaucuggaaaaucauaaucgaucugcauaacggccccuucacaaaaauccaagaacuagguaucaauaauaagaugggcacguuucaaacaaaacacggcauaauccugaccgaaaaugcaaucgucaucuaccaauccccauccggccuguuugaacgaaaagugcgccuaaaagaccuuuga

SEQ ID NO: 6760 - RNA, 4194 nt, Artificial Sequence
  Cas9 variant
augaaaaagguccucggacucgaccuaggaaccaacaguaucggaugggcacucgucaacgaagcaacaaaagaagaaaagaaagaaggaaaaucuucggaaauuauuaaacugggcguuagggucaacccccuaaccgucgacgagaaaaccaauuuugaaaaagggcgcccccuaucaaccaacgccgaccggacccucaaaagaagcgcccgaagaaaccugcaacgguacaaacuucgccgacggaaccuaaucgaaauccuuaucaaaaauggcuuuauaaccaaggacacaccccugacagagaccggcaaggacacuacgcaccaaacacuuaagcuccgcgccaaauccgccaaagaaaaaguagaccucaaagacuucgcuaaaauccuccucaccauuaacaagaagcgaggauacaaaucaagccguaaggucaacagcgacgaagacggccucgcaaucgacggaauggccguagccaaacaccuauacgaacaaaaccucacgcccggacaauacguacuaaaucuccuccagaagaauaagaaauaugucccagacuuuuaccggucugaccugcaagaggaauuuaaaaacauauggaacaaccagaaaacauacuacuucgacauccucaccgauacucuguucgaggaguuaaaagacaaaaacaaaagccaaaccugggcgaucugcaagaaaccauucgacauugcaggcaucaaacaaauagggaaggcuucagacaaacgccuagaacgcuacaaauggagaacagagggccucacccaaaaacuuaaccuggaguaucuugcaauagcgcuccaagaaaucaauaacgacaucaacaaauccagcggcuacuuaggagccauaagcgaccgcagcaaagagcucuuuuucaacaaggaaacggucggagagaaucuguaccgccagcuagucaaaaccccacauaccucccuccgaaaccagguuuucuaccggcaggacuaccucgaugaguucgagacaaucugggaaacccaagcaaaguucuauccccaacugacacacacacuaaaagaagaaauacgcgacguaaucaucuucuaccaacgaaaacuaaagucccaaaaaucccugaucagcuucugucaauucgagucaugggaacaaacauacaucgagaaagaaaccgggaaauccaaaacgcgaacaguugggcgaaaaguuauacccaaaucgagcccccuauuccaagaguucaagaucuggcagaaccuaaacagccuagaguucaggaacuccgacgaaggggaaaucaucgaauuuaucaaacuagaugaagacauccgccagaccgucuucgaggaacucaacuugaggggcaaccucaaacccaacgacguccuuaagauccucggcaacuacauuagccuggguaagguaucacaauggaaaugcaauuucgaggaaauagaggggaaccguaccaacgcagcacucuacaaugucuaucaaauaaucgcggaaaacgaaggcuauggguucgacugggccaagaaaaccgcaucggaaaucaacaaagaacucaagaacaucuucccccaacucggcauagacgcaucaauacucgacuuugacuuuacccaagccaacuucgacaaacagaccuccuaccaacuguggcaucugcucuacagcgcugaagaagacuucaaaauaagcgaagaagacaaaguacuauacgguaauucgagcgucagccucaaaaagaaacuacaccaaaaauacggcuuuaaacccgaauacacuaaacuuuuaacaaacauaucacuccagcccgacuacggcaaccucucagccaaggccaucuguaacauacugcccuaccugaaagaaaauaacguuuacagcgaggcuugcgaccucacuggcuauaaucacuccaauuuccuaaccgccgaagaacaggccaaacgaccacucaaaccgauauuagaacuacucaagaaaaauucacuacgaaacccuguaguugagaaaauacucaaccaaaugguaaacguagucaaccaagucauugagacguacggaaaacccgacgaaauacgcauagaacucacccgcgaacucaagaaaagcgccaaggagcgagcgaacaugacaaaaucuauugccgacgccacccgcagaaacgaugauuacaggaaaacgaucaucaaagaauuuggcaucccaaaccccacaaaaagcgaugucguccgauaccgccucuggcaggaacucgccucacgcggauacaaggacaucuucacugacaccgagaucaaaccccaagaacuguucucgaauaaaaucgacaucgaacacaucauaccaaaagcccuacuguucgacgacuccuucucuaacaaaacucucgccuucaaaaaggacaaccucaagaaggccaacagaaccgcguacgacuuuauagccaaugacuacgcaccaaaccucgaaaauuacauagaacgagucgagucgcuacauaaggaccgaaaaauaacucgggcaaagcggaacaaacuucuaaugcugcaguccaaguuaccggacggauucauugaacgagaccuccggaacucccaauacaucaccaaagaagccaagaagaugcuguacgaaguaugccgcacugucgucucaacaagcggaucgauaacggacaaacuacgcgaggacugggaccucaucaacgucaugaaggaauuaaacuucccaaaauauaaggcauuaggccuaaccgagaaaaucgaacgguaugacaucggcgccgagaaaaugaaagaagucgagaucaucgaagacuggaacaagcguaaugaucaucgccaccacgcgaucgacgcccucacagucgcauucuccacgcacucacauauccaauaccuaaaccaccugaacgcccgcagagaugaaggccauaagaaacacgcagcaaucauagccaucgagucgacaaucacagaaaaagagggaaacaagaaacggcgcuucaucgcgccuuugcccaacuuccgucuccaggcaaaagaacacaucgaaucaauccuggugagcuuuaaaaacaaaaauaaaguagucaccaacaacauaaacaagacaaaacguaucaagaaagacaaauucaacaccaaaguccagcuaaccccaaggggccaacuccacaaagaaaccauauacggaaaaauaaagcaaccauuagaaaagcacauaaaacuaaacaaauccuucacgcucgagcaagccaaacucaucaucgacaagcgccagcgggaaaaaguacuuaaccaccucgagaaauacgcgcacaacagugacaucgccuucaacucgaaaacccuaaagaaaaauccacuacuaaucagcgacgaaccccugaaggaaguacucugcuuugaggaaguuuucacuauacgcaaagacaucucauacgacaacuucaagaaugagaaacaacucgauaaggucaucgaugagaaggugaagcaggcccucaaagagcgcauaaaccaguacaauggcgacuuccgugaagccuucagcgauaucgagcggaaucccaucuggcuaaacaaggcaaaaggcaucugcgucaaacgcgccacuauaaaaggcgucucgaacgccgaaccacuccauacggccaaaaaccaccuaggagaggagguccucacggagaacaaggaacagauccccgucgacuacgugucgaccggaaauaaccaccaugucgcuauauacgaagacgaggacgggaaucuccaggagaaggucguaaguuucuacgaagccgugauccgagucaacgaaggucucccaaucauagacaaagaauauaacaagucacuuggcuggacguuuaaauucaccaugaaacagaacgaaauguuugucuuccccuccgaggacuucaacccaaccgagaucgaccuccucgaucagaagaacgccucccucauaucuccaaaccuuuuccguguccaaaaauucacaauuaaggacuacuucuuucgccaccaccuggagaccaccgucgagaacaacaauacccucaagaacacuaccuggaggcgcgagggccucuccgguaucuauggaauaauaaaaauccgacugaaccaccuaggcgagaucgugcagguaggagaguacuga

SEQ ID NO: 6761 - RNA, 4194 nt, Artificial Sequence
  Cas9 variant
augaacgaaaauaaagagugguuccucgggcuagacaucggcaccgcgucaguaggaugggcagcaaccgacacgaacuacaaccuacucaagcuaaaagggaagaagucguggggagugcgccuauucgacgaggcucaaacggccaaagaacgcagggacugcagauccaagcgccgccgacuggcgcggagaaaauggcggcugggccuauuggaggaacucuucgccgaggaaauaaacaaaauagaccccaacuucuuuaugcggcuccgcgagucgaaauacaaggucagcgacaaaaccggcaacguucccagcauacucuucaaugaaaagaacuacaccgacaaagaauacuaccgcaauuacaaaacgaucuaccaccuacgagccgaccuuauacacaaaaacaaccccgacauacgcgagcuuuuccucgcaauucaccauauacucaaguaucgcggacauuuccucuucgccgggcagcaguucaagggcucagaaaucaaggacaacauacgagaacuccuacaauacaacagccucaacaucaagauugacauaaccgaugaacugauaaacaacauagcggaaauccuucucaagaagaaaaacagcaccgacaaaaucauagaguucaagaaacucuucgcggacgaaaaacaacuuaucgaggcccuccgacuagcccucgggaacaaaacccagcucgcaaaacuguucgacaucgaagcguacaaagagcuagacaucagcaucaaaaccaucucguucaaagagaaaaucuacgaagacguacgcagcaacuaugaagaaauucucggcgaauacauuaucguacuggacacagcaaaacuuaucuacgacgcgaucauccucucuaaaauaaagaucaaaaacaugaccauaagcgaauccaaggucgucucauacgagaaacacggcaaagaucuaaaacagcucaaacaccuuaucaaggaggacugcaaacugagcaaaaaggagaagcgacagcuauucgaaaacaucuucgugaaggaagacgagaaaggcgcuaacuaugucaacuacauaggcaaaaacaacgccggauccuccaaaucuucaugcucguaugaggacuucaagaaauuccucaccaaggagcucaagugcugugaggagagcaaacuuaaacaagacauccuggcagagcuggaauuggagacauucuugccccgccaacggacaaaggacaacagcguaauccucuaccagauccacaaagaagaguuagaaaagauccucaacaacgcaguccaauaccaccccuucuuaaacaacacggaugaauacggaauuucuauaaaggaaaagaucauacaacucuuagaguuccgcaucccguauuauguuggaccgcuaaacaccucgcacaaagugggagacggcggcuucucuugguccguccggaacaaagguuacgaacauaucgcgguaacgccauggaauuucaacaaggucauaaacaaggaagagucagccaagaacuucaucgagaaucugacuaaccagugcacguaccuacuuuacgaggacguccugcccaaacacucccucuuguacucagaauuugcacuacucaacgaauuaaacucgauuaacuacggagggaaacggcuaacggucgaacauagaaaccucauaaucgaacgcuucuucaaacaauccgccccuaaggccaccggaaaagagcuaaagaaauuucuuauguccgaaggaguaaucgacggcaaagacgagcuaucggguuucgacgugagcaucaaaaacgaccucaaaucauaccgcgacuucaagaaaauacucggggacaaauucgacucagagaaagucgagaaaaugauccgguggauaacacuauucggcgaauccaaacagcuucuagucgacaaaauaaccaaggaauacggagacaucuacucccucgaagaaaucaagaaaauaucgggacuaaccuacaaagauuggggucgccucuccgaaaaacuccucacagagaucgugaguucacagcuauacgacgaguccaccggagaaugcuucaacaucauuaacgcgaugcgcaacaacacccugcuguucauggaacuccugggaaccaacuacgacuacuucgagaaaauaaacaucuauaaccgccgauugagaaaagaaauaaccgagauaacaccgcacauccuugacgaccuguacguaucacccgccguaaaacgcuccaucuggcaagucguccgcaucguugaggaacuaaagaaaaucauagguucggaaccaaaacgcauauucguagagacgaccaggucgaacaaagaaaagaaaggcgacgacggccggaaagacagcagaaagaaagcccuacuagaacucuacaagaaaaucaaaaccagcgacaucgucgaacuugagaaagcccucggucacacaguagacuucgacaaaaagaaacaggaccuaaccgacaucgacaauaacaaacucaaagcuagaaagcucuaccucuacuacacccaauuagguagaugccuauacaccgggaaagcaaucgaccuuaacaaccugcucuccuccaacucggaauacgacgucgaccacauauacccucagagcaagaccaaagacggcuccuggaacaaccucguacuugugaacaagaccgaaaacagcaaaaaguccaaugggcucaucucagaguccauccagcgaaagaacaagcacuucuggcguuuccucaaagcuaaaaaccucaucagcgaagaaaaguacaagcgccuaacccgcaccgaggacuucacagacgaugagcuaucgggauucaucgcucgccaacucauagaaaccucccaauccguuaaagcagugucucagauacuacaaaaucucaacccaaccaccgaaaucuguuuuucgaaggcagagaacguccaugauuuucgacaagaauuuggcaaaauaaaggucggcaaacgacgcaaccugacagaggaacagcaaaaagaagccaaagagggccaacuaauaaagguccgcgaccucaacgaccugcaccacgcgaaagacgcauaccugaacaucgugguaggaaacguuuaucacauaaaauucacucggaacccaaagaacuuuauacggaaaaacagcaaaaaccgcgaauacacccuaaacacccuauucuacagcgacaaaaucgagagaaacggcgaagucgccugggaaaagggcaagacggagaaaaucguauccagugucaugugcaacaaccugauaaacgucaccagaagaaccagcgaacaaaagggcgcgcuuuacgacgcaacaauuuacaaagccaacgccgcgaaggaaggcuccuacuaccccgugaaaaccaagaacaagaaccugaaagacgucacccguuacggaggcuuuaccucgauaaaaaucgccuacuauagcaucuuuaaauaugacauacgcaauaaagacaaagucaaagagaauaucaaaauaauccccauacccauauauauaucccaaaacaucaaaacagaccuagaccugaucaacuucgccgagaagcaaaucaaacugaagaagggugagaacaucgaaaaccuccaacuaaucuacaagaaacuuaacauaggugcccucgucaaaaucgacuacuaucccuacuacgucgggggcaaaacuaacgacaacuucuacaucgacggcgccgugcaaguacuccugucaagcgacauagaaagauaucucaaagaaguggugaaauucgucaacuuccaacgagagaacaaagaagcgaaaguauccaaagaacacaucuccagcgaagagaacaucgaacucuacaacacgcuacugugcaaaaugacggccaagauuuuuacccacaccaaaaacaauaaguacaacgaccuagcgcaggacaaggccaaaaacacuuucaagaacuuguccuuagaagaacaaugcaaagugcuacucgagauccucaaucuccucacaaauaagaagaccacauucgaccucucccugauaaaugaaaaagccagccgcguaaaaugcggcuucaaccuacucaaccagaaacaauucucgauaaucgaacaaucaguuaccggacuauacgagaaggaaaucaagauaaucgaagauuga

SEQ ID NO: 6762 - RNA, 4197 nt, Artificial Sequence
  Cas9 variant
auggagacacaagcgucgaaccagcucauaucuagccaccuuaagggcuauccaaucaaagauuacuucguaggacuagacaucggcacaucuagcgugggaugggcagugacaaauaaggccuacgaguuacuuaaguuccgaagccacaagauguggggcagucgccucuucgaugagggcgagucagccgucgcccgacgaggcuucagaagcaugagaagacggcucgaaaggcguaaacuccgccucaaacuacuagaagaacucuucgccgaugcaauggcgcaaguagaccccaccuucuucaugcgccuccgagagagcaaauaccacuacgaggacaagaccaccggccacagcaguaaacacauccucuucauagauaagaauuacaacgaccaagacuauuucaaagaauacccaaccgucuaccaucucagaucugagcucaugaaaucugggaccgacgacauaagaaaacucuuccucgcaguccaucauauacuaaaauaccgaggcaauuuccuguaugagggagccaccuuugacucgaacgcauccacucuagacgacgucauaaaacaagcacucgaaaauaucaccuucaacugcuucgacugcaacuccgcaauaucgucgaucggacagauccucauggaagcaggcaagaccaagagcgacaaagccaaggcgaucgaacauuuaguagacaccuauaucgcaacugacaccguggacacauccaguaaaacgcagaaagaccaaguaaaagaagacaagaaacgauuaaaagccuucgccaaccuuguccucggccugaacgcuagcuugaucgaccucuucggcucaguagaggagcuggaagaggaccucaagaaacuucagauaacaggugacaccuaugacgacaaacgggacgaacuagcuaaagcauggucagacgagaucuacauaaucgacgacuguaaaucaguguaugacgcaaucauccugcuaucaaucaaagagccaggacugacaauauccgagucgaagguaaaagcauucaacaagcacaaagacgaccucgccauccucaaaucccuccuaaaauccgacagauccauauacaacacaauguucaaggucgacgaaaagggccuccacaacuacguccacuauaucaagcagggccgaacagaagagacgucaugcaaccgagaggacuucuacaaauacaccaaaaagaucgucgaaggccucuccgacuccaaagacaaggaauacauucuuucgcaaaucgagcugcaaauccuacucccgcugcagcggaucaaagacaaugggguaauccccuaccaacuccacuuagaagaacuaaaggccauucuagcgaagugcgggcccaaauuccccuuccuaaacgaaguagccgacggcuucagcgucgcggaaaaacugauaaaaaugcuagaguuccgaaucccguacuaugucggaccccuaaacacacaccauaacgucgacaacggaggguucgccugggccguucggaaagccuccgggcgcgugaccccuuggaacuucgacgacaagaucgaccgugaaaaauccgcugccgccuucaucaagaaucugacaaacaaauguaccuaccuccucggcgaagacgugcucccaaaaucaucacuacucuacuccgaguucauguuacuaaacgaacuaaacaacguccgcaucgacggaaaacccuuggaaaagguaguaaaagagcaccuaaucgaagccgucuucaagcaagaccauaagaaaaugacuaaaaaccggaucgagcaguuccuaaaagacaacggauauauaagcgaaacccacaaacacgaaaucacaggccucgauggcgagaucaagaacgaccucgcauccuacagagacaugguucgaauccucggagauggauucgaucgcucaauggcggaggagaucauuaccgauaucaccauauucggcgagucgaagaaaaugcuucgggagacacuacgaaagaaauucgcauccugccuagacgaugaagccauaaagaaacucacaaaauugagauaccgagacuggggccgauugagccaaaaacuccuaaacgguaucgagggaugcgauaaagcgggagacggcacccccgagacaaucaucauccucaugcgaaacuucucauacaacuuaauggagcugcucggcgacaaguuuagcuucauggaacgcauccaagaaaucaacgcgaaacuaaccgaaggacaaaucguaaacccucacgauaucaucgaugaccucgcgcuaagcccggccgucaagcgcgcaguauggcaggcccuaaggaucguggacgaggucgcgcacaucaaaaaggcucucccggcgcgaaucuuuguggaagucacaagauccaacaaaaaugaaaagaagaagaaagauagccgucagaaacggcucucagaucuuuacgcagcaauaaagaaagacgacgugcuacuaaacggccucaacaacgaaauauucggcgagcuuaaaucaucauuagcaaaauaugaugacgccgcccucagaucaaagaaacuguaccuauacuacacccagaugggccgaugugccuauacaggggaaauaaucgagcucucccuccugaacacggacaacuacgacaucgaucacauauacccccgaucucuaacgaaagacgacuccuuugacaaccuuguacugugcaaaagaacagcuaacgcccagaaaagcgacgcauacccgauauccgaagaaauccagaaaacacaaaaacccuucuggaccuuccuuaaacaacaaggauugauaagcgaacgaaaauacgaacggcuaaccaggauaacgccccucacggcggacgaccuguccggcuucaucgcucgccagcucguagaaacaaaccagagcguaaaagcagccacgacccuacugcgacgccuguacccaggcgucgacguagucuucgucaaagcagagaacgugaccgacuucagacaugacaacaacuucaucaaaguaagauccuugaaccaucaccaccacgccaaagaugcauaccugaacaucguugucggaaacguguaccacgagcgcuucacccgcaacuuucgcgccuuuuucaagaaaaacggagcaaaccgcaccuauaaccucgcaaaaauguucaacuaugacgucaacugcacgaacgcgaaagacgggaaagccugggacguuaaaaccagcauggauaccgugaagaaaaugauggacucaaaugacguucgcgugacaaagcgacuccuagagcaaaccggagcacuagccgacgcaaccauauauaaagcaacagucgcuggcaaagcaaaagacggagcauacaucgggaugaaaaccaagucaagcgucuucgccgacguaagcaaauacgggggaaugaccaaaaucaaaaacgccuacagcauaaucgugcaauacaccggcaaaaagggagaggucauaaaagaaaucgucccgcuacccaucuacuuaacaaaccgcaacacgacggaccaggaccuaaucaacuacguagcaucgaucaucccccaagccaaagacaucucaaucaucuacggaaagcuaugcaucaaucaacucguaaaaguaaacgguuucuacuacuaccugggcgguaaaacuaacucaaaauucugcaucgacaacgcgauacaagugauagugucaaacgaauggaucccguaccugaaagugcucgaaaaauucaacaacaugcggaaagacaacaaagaccugaaagcaaacguuguauccacuagagcccucgacaacaaacauaccauagaaguccgcauaguugaagagaaaaauauagaguucuucgacuaccucguuucaaaguugaaaaugcccaucuaccagaaaaugaaaggcaauaaagcagccgaacuauccgaaaaaggauacggacucuucaagaaaaugucgcuggaagaacaaucaauccaccugaucgagcuguugaaccuacuaaccaaccagaaaacuaccuucgaagugaaaccacucggaaucacugccucacgaucaaccgucggaucuaaaauuagcaaccaagacgaguucaagguuauaaacgagagcauuacuggacuauacucaaacgaaguuaccaucgucuga

SEQ ID NO: 6763 - RNA, 4197 nt, Artificial Sequence
  Cas9 variant
auggagaaaagcuacucuauaggguuggauauaggcacaaacagcguaggcugguccguaaucaccgaugauuacaagguccccgcaaagaaaaugcggguacucggcaacacagacaaaaaguacauuaagaaaaaccuccuuggggcccuccuguucgauuccggcgaaaccgccgaagcaacccguuuaaagcgaacugcccgacggcgauacacccgccgcaaaaaccgacuccgcuaccuccaagaaauauucgcaaaagaaauggcaaaaguagacgagagcuucuuccaacgucucgacgaaaguuucuugacagacgacgauaagaccuucgacucacacccgaucuucggcaacaaggcagaagaagacgccuaccaccaaaaauucccgaccauauaccaucuacgcaaacaucucgccgacucccaggaaaaagccgaccuacgccucaucuaucucgcauuggcacacaugaucaaauucagaggacauuuccuauacgacaacuuuaaugacgacaacuucgacuggcgcaacaucgacauccaaaaacguuacgaagaguuuauagagacuuacgacagcacgcucggcgaguccuaccuugccgauauaucuguggacgcagcgucaauauuagaggaaaaagugaguaagaccgaacgacucgagaaccuucuuaaauacuaucccaccgagaagaaaacgaccuucuucgguaaucucauaaaacucauacuuggacaacaagcaaaguucaaagcaaucuucaaccuagaggacgaaaucagccugcaauuugccacccccacauacgacgaggacuuagaggagcuccucggcaaaaucgacaacggcgacucauacucagaacucuucguagccgcacaaaaccuuuauaacaccauccuccuggcaucguuccuuaaaaccgacaacaaauccgccaaagcgccauugucaaccagcaugaucgagcgauacgagaaccacaagaaagaucuggcuaaacuaaaagacuuugucaaaaagaacugcccagaccaauaccaugacauauucagggacaaaagcaaaaacggauacgcggguuauauagacaacggcguaucacaaaaugacuucuacaccuucauagggaaaugccuagaagagucgcugaaaaaggacaagggcgcccaguacuuccucgacaaaaucgaccgggacgacuuccuucgcaagcagcgaacuuucgauaacggcgcguuucccuaccagauccaucuccaggaaaugcacgcaauacugagacggcaaggcgauuacuacccuuuccuaaaggaaaaccaagacaagaucgagaagauccuaaccuuucggauccccuacuacgugggcccccuagccagaaaggacucgcgcuucgccugggcaaacuaccggagcgacgaggccaucaccccauggaacuucgacgaggucguggacaaagaaaaaucagcggagaaauucauuacccgcaugacccucaacgacuuauacuugcccgaagaaaaaguccuuccaaaacauagccuaauauacgaaacauucaccguuuacaacgaacugacgaacaucaaguacgucaacgaucagggcaacgcaauccacuucgacuccgaacucaaggagaagaucuuuaaccaacuguucaaagaaaaccgcaagguaagcaagaaaacacuuaucgacuuccucaauaacuccgaaggaaucuauaccgacaaacucguaggcauugacgaagaagugaaauaccuaaacgcgucccucgggaccuaccacgaccucaagaagauccucgagaguuucauggaugacgagaucaacgagaaaaucaucgaggacaucauccaaacauugacgcuauucgaagacaucgaaaugaagcgacaacggcuucaaaaauaugacgacauauucacaccuaagcagcugaaagagcucgcgagacgcaacuauaccggcuggggccgccuauccuacaaguuaauaaacgggauccgaaauaaagagaacaauaagacaauccucgacuaccugaagaauggcaauagaaauuucaugcagcugauaaacgacgaucgccuaaguuucaaacagaucaucauagacgcacgcaagaucgagaaacucgacaacaucgagucagucgucuacaaccuacccggaucucccgccaucaagaaaggaauacuacaaucgauuaaaaucguagaugagcuggucaaaguaaugggccacaaccccgacaacaucgucaucgaaauggcgagagagaaucaaaccaccaaucaaggcaaaaaccggucccaacaaagauuaaaacgccuacaagacucaaugaguaacuucaaggacuccucaaucagccucaaagacguagauaauuccgaccuccaaaacgaccgccuauuccuuuacuacauccagaacggcaaagauauguauacuggcgaagaacuggauauugaccaccuaucggacuacgauauagaccacauaauuccccagagcuucaucaaggacaacagcaucgacaaccgaguccuaacguccagcgccaagaaccgaggaaaaagcgacgacgucccgggcagagacgugguccuaaaaaugaagcccuucuggaagaaacucuacgacguaaaacuuauaucuaaacgaaaguucgacaaucuaaccaaaucugagcacgggggccuaaccgaaagcgacaaagcaggauucauuaaacgucaacuuguggaaacucggcaaaucacgaaauacguagcccagauacuugacggccguuucaacaccaaacgcgacgauaacaacaaggucauccgugacgucaaagucauaacccuuaagagcucccuaguaagccaguuuagaaaggacuucgguuucuacaaaguccgcgaaaucaacgacuaccaccacgcgcacgacgcauaccugaacgccguagugggcacugcgauccucaagaaauacccaaaacuagcuccggaguucgucuacggugaauacaaaaagugcgacguccgcaaacuuaucgcaaagucgggcgacaaauccgagaucggaaaagcuacugcaaaguacuuuuucuauaguaaucucaugaacuucuucaaacgcguaaucagauauagcaacggcaugaucgugguccggcccgugauagaguacagcaaagacaccggagaaauugccugggacaaagaaaaggacuucaagacgguaugcaaaguacuguccuguccacaggucaacauagugaagaaaguggaaaaacaaagccacggucuagaccgaggaaaaccaaaaggguucuacaacgcgaacccaucucccaaaccgaagaaaggaaguaaagugaaccucguccccaucaaggccaaccucaaucccaaaaauuacggaggcuacgccggaaucuccaacagcuacgccguacucguggaugcuacgaucgaaaagggcgccaaaaagaaacucacgcgaauccaagaguuccaaggaauaucaaucauagaccgagaaaaauacgaaaagaacaaaguggaguuccuaaaaggccuagguuacaaagaaaucuacuccaucaucacgcuccccaaauacagccucuucgaacuagcagacggcucccggagaaugcucgcgucaauccuaaguaccaacaacaaacgaggggagauccacaagggcaacgaauuagucuuacccgcuaaauacaucccccuccucuaccacgccaaccgcauccacaacaccuucgagaccggccaccgagaauacguugaaaaacacaucgcggaguucaaagaaauagcggaaauaauccuagaguucaacaacaaauacgucaacgcaaagaaaaauuccucgaucaucgaaaaagcauuggagagcuucgacuccuucucgcuggacgaaaucugcgacuccuucgucgguaaacucaagaaaaacaacaccaaaaagaacagcggacucuucgagcuaguaagccucggaagcgcaucggacuucgaguuccuagaaacaaaggucccccguuaccgagacuauacaccgagcucccuacucaacgccacccucauccaucaaagcaucacaggacuuuacgaaacccgaauagaccucuccaaacucggcgaagaauga

SEQ ID NO: 6764 - RNA, 4197 nt, Artificial Sequence
  Cas9 variant
auggaaacacaggccuccaaccaacuaauaagcucccacuuaaagggauaccccaucaaggacuacuuuguuggauuggacauagguacuucaagugucgggugggcaguaacaaauaaagccuacgaacuccuaaaguuucguucgcacaagauguggggcagccgccuguucgacgaaggagaauccgccguugcacgcagaggguuucgcuccaugcgccgucgacuagagcgccggaaacuacgccugaaauuacuagaggaacuguucgccgacgccauggcacaaguggacccaacauucuucaugcgucuccgagaauccaaauaccauuaugaagacaaaacgacagggcacucgucgaagcacauccuauucaucgacaaaaauuauacugaccaggacuacuacaaagcauacccgacuauauaccaccuccgcgccgaacugaugaaagacgguacauacgacauccgcaaauuauuccuagcaguccaccacauccucaaguacagagggaauuuccuguacgaaggggcgucauuugacucuaacgccucaacacuagacgacguccucaagcaggcccucgagaacauaacauuuaauugcuucgauuccagcgccgcaauaggaagcaucggacaaauacucauggagaccggcaagacaaagagcgacaaagcgaagacaauugagaggcucgucgacacauacauaauuaccgacgaaguaaacgcgagcggcaaaacccaaaaagaccaagucaaagaagacaagaaacggcucaaggccuucgcaaaccucguucuaggccuaaaugcaagccuuauugaccucuucggcucuguugaagaacucgaagaagaccuuaaaaagcuccaaauaacaggggacaccuacgaugacaagcgcgacgaacuagcaaaggccuggucggacgaaaucuacauaaucgacgacugcaagagcguauacgacgccaucauuuuacugucaauaaaagaaccaggauuaaccaucuccgaaucuaagguaaaggccuucaacaaacacaaagacgaccuagcuauccucaaaucccugcugaagucugaccgaucuaucuacaacgccauguuuaaaguugacgagaaaggacuccacaacuacguccacuauaucaagcaagggcgaacagaagaaacuagcugcaaucgcgaagacuucuauaaguacacaaagaaaguaguggaaggacuucccgacagcaaggacaaagaauacauccuauccgaaaucgaacuccagacccuccucccccuccaaagaaucaaagacaauggaguuaucccuuaccaacuccaccuagaagaacucaaggucauacucgccaaaugcggcccaaaguuccccuuccugaacgaaguagccgacggcuucuccguagccgaaaagcucaucaaaaugcuagaguuccgaauaccauacuauguuggaccacugaacaccucacacaacgucgacaacgggggcuucgccugggcuguucggaaagccucuggacgagucacccccuggaacuucgacgacaagauugaccgcgaaaaaucagccgccgccuuuauuaagaacuuaaccaacaagugcaccuaccuacuuggcgaagacguacuaccaaaaaguucccuacuauauucagaauuuaugcuccucaacgagcuaaacaacguccguaucgacgggaagccacuagaaacaaaaguaaaggcccaccucaucaaagcaguuuucaaacaagaccacaagaaaaugaccaaaaacagaauagagcaauuccucaaagauaacaacuauauacccgagaaacacaaaccggaaauaaccggccucgacggcgagaucaagaacgaccucgccucauaccgagacauggucagaauacugggcaacaacuuugaccucagcauggcggaggagauaauaacggacauuaccaucuucggcgaaucuaagaaaauguuacgagaaacgcuccgcaaaaaguucgcauccugccuggaugacgaagccaucaagaaacuaucuaaacuaagauaccgcgauugggggagacuuucaaagaaacuccuaaacgggaucgaugggugcgacaaagccggcgacgggaccucggugacaauuauagaagccaugcgagacuucuccuauaaccuaauggaacuacuaggagaccgcuuccuguucauggaacgaauccaagagaucaacgacaaacucacggaaggacagaucguaaacccgcacgacaucauagacgaccuugcccuaucucccgcaguaaaacgggcaguauggcaagcacucagaaucguagacgagauaguccacauaaagaaagcccugcccgcccgcaucuucguugaagucacucgaaguaacaaagccgagaaaaagaaaaaggauucgcgacaaaaacgacuaagcgaucuauaugcggccaucaaaaaggacgacgcccuccuuucagggcugaccaacgaggaguuugguggacucaaguccgaacuugcaaaguacgacgacgcagcgcuccgaucuaagaaauuauaccuauacuacacccaaauggggcgcugcgcuuauacgggcgaggucaucgaccuaucacaacugaacaccgacaacuacgacaucgaucacaucuacccccgaagccucaccaaagacgauucauucgacaaccuuguacucugcaaacgaaccgccaacgcccagaaaucagacacauacccgauaucgaaagaaauacagaaagcgcaaaaggcguucuggauauuccucaagcaacaaggccuaauauccgaaagaaaauacgagcgauugacaagaaucacgccccuuaccgccgacgaccuaucaggcuucauagcucgucaacuugucgaaaccaaccaaucggucaaagcggcaaccacccuccuccgccgccuauaccccgauaucgauguagucuucgucaaagccgagaacgugaccgauuuccgacaugacaacaacuucaucaaggugcgaagccugaaccaccaccaccacgcuaaggaugccuaccugaacaucguggucgggaacgucuaucacgagaaauucaccagaaacuuccgcgccuucuucaagaaaaauggugccaaucgaaccuacaaccucgcgaaaauguucaauuaugacgugaaauguaccaacgcaaaagacgggaaagcaugggacguaaaaaccucgauggacacuguaaacaagaugaugacgagcaaugacguccgggugacgaaacgccuacucgaacaaucaggcgcacucgccgacgcaaccgucuauaaggcgaccguggccgccaaggccaaagacggcgcauacaucggcaugaagacaaaaucgagcgucuucgccgacguaaccaaguacggcggcaugacaaagaucaaaaacgccuacuccauaauaguacaguacaucggcaagaaaggagaagucgugaaagaaaucgucccccuucccauauacuuaacgaaccgcaacaucaccgaccaggaccucaucgacuacgucgcauccauaacgccccaagcaaaagacaucaguauaauauaccgcaaacuaugcauuaaccaguuagucaaggugaacggauucuacuacuaccucggaggaaaaacgaacucgaacaucuacauagacaacgccgucgaagucguagugccugccaacaucgcaguauacauaaaaguccuugaaaaauucgcccuuuugcacaaagauaacaauaacauaaaagccuccaccgucaccacucguauauacaaugaggggagcaccaacauagucucaaucaccgacaaggacggccugaucgucuaugauuaccuaaugucgaaacuacgcacaccacuguacaugaaaaugaaaggcaauaaaguagacgagcugagcacuguagggagaagcaaauucaugaacaugacacuagaggaacaaagcauauaucuucuugaaguccuuaaccuacucacaaacuccaaaacaacauuugacguaaaggcauugggcaucacggccucccgaagcaccauuggagucaaaauacacacccucgacgaguucaaaauaauaaaccaaucgaucacaggccuauauucgaacgaaauaaccaucguauga

SEQ ID NO: 6765 - RNA, 4197 nt, Artificial Sequence
  Cas9 variant
auggaaacgcaaaccagcaaccaacucauaaccucucaccugaaggacuacccaaaacaagauuacuucguaggccucgauaucggcacaaacucaguagguugggccgucaccaauacauccuacgaacuccucaaauuccacagccacaaaauguggggaagccgcuuauucgaagaaggugaaucagcagucacacgaaggggcuuccgcaguaugcgacgcagacucgaacggcgcaaacucaggcuaaagcuccuagaagaacucuucgcugacgcaauggcacaagucgacucaacauucuucauccgacuccacgaaagcaaauaccacuacgaggauaaaacuaccggccacucaagcaaacauauccuauuuauugacgaggauuacacagaccaagacuacuucacagaauauccgacaaucuaucaccucagaaaagaccugauggaaaauggcaccgacgacauccgcaaacuauuccucgcuguccaccauauccugaaauaccgcggaaacuuccuauacgaaggugcgacauucaacuccaaugcauuuaccuucgaggaugugcuuaagcaagcucucgugaacauaacguuuaacugcuucgauaccaacucagcgaucagcagcauauccaacauucucauggagagcgggaagaccaaaagcgauaaagcgaaagcaauagaacgacucgucgacacguacaccguauucgacgaagucaacaccccagacaaaccccagaaggaacaagucaaagaagacaaaaagacacuaaaagccuucgccaaccuaguacuaggccucucggccaaccucaucgaccucuucgggucgguagaggauaucgaugacgaccuaaagaaacuccagaucgugggcgacaccuacgacgaaaaacgggacgagcucgccaaggucuggggagacgaaauacacauuauugaugacugcaagucaguguacgaugcaaucauauugauguccauaaaagaacccgggcucacaaucagccaaagcaaaguaaaagcauuugauaagcacaaggaggacuuaguuauacucaaaucucuacugaagcuagaccguaacguuuacaacgaaauguucaagucugacaaaaagggguugcacaacuacguucacuacauuaaacaaggacgaacggaagaaacguccugcucacgagaagacuuuuauaaguacaccaaaaagaucguagagggacuagcggacagcaaggacaaagaauacauacucaaugaaauagaacugcagacacuacugccguuacaaaggaucaaagacaacggcguaauccccuaucaacugcaucuagaagaacucaaaguaauccucgacaaaugcggaccaaaauuccccuuucuacacaccgucucagacggguucucggucacggaaaagcucauaaagaugcucgaguucagaauacccuacuacgugggcccccugaacacccaucacaacauagacaacgggggcuucucaugggcugugcgaaagcaagcagguagagucaccccauggaacuucgaggaaaagaucgaccgagagaaaagcgcagccgcauucaucaaaaacuuaacaaauaaaugcacauaccucuucggcgaagacgugcuaccaaaaucaucacuccucuacucagaguucaugcuacucaacgaacucaacaauguacgcauagacgggaaagcgcucgcacaaggagucaaacagcaccuaauagacagcauauucaaacaggaccacaaaaagaugaccaaaaacaggauagaacuguuccuaaaggacaacaauuauaucacaaagaaacacaaaccagaaaucacuggccuggacggggaaaucaaaaacgaucucacgucauacagggauaugguccguauccucggcaacaacuucgacguguccauggccgaggacaucaucacagacaucaccaucuuuggggaaagcaaaaagaugcuccgccagacacuacgaaacaaguucgggucacagcugaacgacgagacaauuaaaaagcuaagcaaacuacgguaccgagacuggggccgguuaucgaagaagcuccucaaagggauagacgguugcgacaaggcaggcaacggagccccgaaaaccauaauagaacugaugcgaaacgacucauacaaucugauggaaauucugggagacaaauucucauuuauggagugcauugaggaagaaaacgccaaacucgcacaaggucaagucgugaacccacaugacauaauagacgaacuugcgcuuucacccgcugucaaacgggcgguuuggcaagcacuccguauagucgacgaagucgcccacaucaagaaggcccuccccucccggauauucgucgaggucgcacgaaccaacaagucggaaaagaagaagaaagacagccgccagaaaagacuaucugaucucuacagcgcaauaaagaaagacgaugugcuccaaaguggccuccaagauaaagaguucggcgcccugaaaagcggccuagcaaacuacgacgacgccgcccuccgaucaaagaaauuauaccucuacuacacgcagaugggccgcugugccuauacaggcaacauaaucgaccucaaccaacucaacaccgacaacuaugacaucgaucacaucuacccccgaagccugaccaaagaugacucguucgacaaccuuguacucugcgaacgaacggcaaacgccaagaaaucugacaucuacccaaucgacaaccgaauccagaccaaacagaaaccauucugggccuuucucaaacaccaaggccugauaagcgaaaggaaauacgaacgccuuacccgaauagcgccccuaaccgccgaugaccuuagcggcuucaucgcgcggcagcuagucgaaacuaaccaaagcgugaaagccaccaccacacuacucagacgccuguacccggacauagacguuguguucgugaaagcugaaaacguaagugacuucagacacaacaacaacuucauaaagguacgcucgcuaaaccaccaccaccacgccaaagacgccuaccugaacauaguagucggcaacgucuaucacgaaaaguucaccagaaauuuucgccuguucuucaagaaaaacggggcaaaccgcacauacaaccucgcuaaaauguucaacuacgacgucaucugcaccaacgcgcaagacgggaaagcgugggacguuaagacguccaugaacaccguaaagaagaugauggccagcaaugauguccgcguuacacgucgccugcuagagcaaagcggagcccucgccgacgccaccaucuacaaagcguccguagccgcuaaagcgaaagauggcgcauacauaggcaugaaaacaaaauacagcguuuucgcagaugucaccaaguacgguggaaugacaaagaucaagaacgccuacagcaucaucguccaauacaccgggaaaaagggcgaagaaaucaaagagaucguaccccuccccauauaucuaaucaaccgcaacgcuacagacaucgaacuaaucgacuacgugaaaucuguuaucccuaaggcuaaagacauuucgaucaaauacagaaaacugugcauuaaccagcucgucaagguaaacggcuucuacuauuacuuaggcggaaaaaccaacgacaaaauauacaucgauaaugccauugagcuaguggucccccacgacaucgccaccuacauaaaacugcucgacaaauacgaccuccucaggaaagaaaacaaaacccugaaagccagcagcauuacuaccucaaucuacaauauaaacaccuccaccgugguaagccucuccaacaaagucgggaucgauguuuucgacuauuucaugagcaaacuucgcacaccccucuacaugaagaugaagggcaacaaaguugacgaacucucaaguacaggccgaucgaaguucaucaaaaugacgcucgaagaacagucaauuuaucuccucgagguccucaaccuguugacuaacuccaaaacaacguuugacgucaaaccccuaggaaucaccggcucacgcucaaccaucggcgucaaaauacacaaucuagaugaguucaagauaaucaacgaauccaucacaggacucuacagcaaugagguaacgaucguauga

SEQ ID NO: 6766 - RNA, 4200 nt, Artificial Sequence
  Cas9 variant
augaagaccauauuaggacuagaccuaggcaccaccucgaucggaugggccuuagucaaggaagccgaaccguucagcgacgagaaaagugaaauugugcgguuaggaguccgcgucaucccgcucacggucgacgaacgaacaucguucgaaaauggaaagagcauaacaaccaacgcccuuagaacccaaaagcgaggcaugcgccgaaaccuucaaagauacaaacuccggagacaagcgcucaucgaggaacucaaauccaccggauggauaggcaacgacuuuauauucagcgaaaccggaccagggagcacauuccggacacuccgacuccgcgcaaaaagcgcuagugaagaagucacacugggcgaccuagcccggauucugcuccaaauaaauaaaaagcgcggcuacaaauccucccgaaaaauggucagcuccgacgacgggcaagcaaucgacgggauggccgucgcgaaagaaauguacgacaagggccucacgccaggcgaguacgucuaucagcggaugcucgaaggcaaauacgcaauacccgaguucuauaagagugaccugcaagaagaguucgaccgaauaugggcgcuccagaagucauuucacauagaacuaaccgacgaacuguaccgcaaacugagugaccggaacaagucccaaacgugggccaucugcagagacgaacuaggcauccagggccuaaaaagcucauucauagguaaggaacguuuaaaagaagccuaccgauaccgucaccucgcggcgacacaagaagucaacauggagguacucacgugcgcgcuacaagagaucaacggacaaaaggccagccugagcggccuucucuccaaaauaucagaccgaagcaaagaacucuaccucaacaaccuuaccgugggucaaaugcuccucaaacgcauagaggacaaccccaauaauucacucaagaauaucguauucuaccgccaggacuauuuggacgaguucgagaggaucuggacagugcaaagcaaauaccacaccgagcuuacacaugaacuaaagaaacgccuacgggacauaaucaucuucuaccaacgcccccugaaaagccaaaaagggcuaaucucccuaugcgaacuagagaccaaagacaucgaaguagcgauugacggaguaaagaaaaugaagaacauagggccaagagucugcccgcgaucaagcccccucuuccaagaguucaaaauauggcaaacuaucaacaacauuuucgugaacggcgcggcgcucgacgacgaagacaaaucuguaauagccaaagaacuuauguucaaagacaaacucaaggauagcgaccuccucaaacugcuguucaaaaccacgaaaggucaaucgguaaacuucaaagagguagacggaaaccgcaccauggcgacgcuaaugaaggcaugcuucaaaauagcagaaaaccuaggcuacgacgacaucggucucagcaaacuuagcagcgaggaccagauggucaggauugaaggaaucuucaaagaacagggguucaagaccggcuucuuacacuucgacagcagccuagccucuccggaguucgaaaaccaagacagcuacaggcuauggcaucugcuauauagcuacgaaggcgacaaaagcgcguccgggaacgaaagccuggucaagugcauaauggaccucuguagcauggaugagggaagugcgaaaauauuagcguccuguacauuccuuccggacuacggaucacugucugccaaagccaugcgaaaaauccucccuuacaugaaagacgggcuggaauauaccgcugccugcgccauggccggauacagacacagcaagcgcagucugaccaaagaggagcuagacaccaaagaauacagcgaccgccuuagccuacugcccaaaaacagucuccgcaacccaguaguagagaaaauacuaaaccagaugaucaacguggucaacagcguaaucgacgucuacgggaaaccggacgaaauaagaaucgagauggcgagagaacuuaagaaaagcgccaaagaacgcgaggaagcccaaagggauaucgccuccucaaccgcggagagccagaagguaauagaaauacuaaagggcgaacccuucuuucuucaguuucccacccgcaacgacauaaucagauaccggcucuaccaagagcuggcacaaaacggcuucaagacccuauacagcaacacauauaucccaaaggacaaacucuucagcaaagaguucgacauagaacacauaauuccacaagcccucaucuucaacgacagcuucgcaaacaagacgcucgagucacgccaauguaacuuagaaaagggaaaggagacagcaauggacuaugucaagagcaaauacgacgaaaccggaguacaaaccuacugcgacagagugaacggccucaucggcaagggcauaucaaaaacaaaagcaaaauggcugcuaauggaaggaaaagacauccccgaagauuucauaaaccgagaacuucgggacucacaauacaucgcaaagaaagcacgagaaauucuagaaagccuaguaaaauucguagucccgaccaccggcucaguaaccgccagacuccgcgaggacuggcagcuuguaaauguuaugcaagaacuuaacugggagaaguaugcgcgucucggccucacuggaguccgagaggacaaggaugggcgccgcauccccuucauacaggacuggaccaaaagaaaugaccaccgccaccacgcgauggacgcgcuaacaauagcguucacacgcagacaauuuauacaauaccucaaccaccucaacagcaaaauugacguagugagcugggacaagaaagaccuggaccuacgagauuacgaccuugaagacauuaaauucggcaaccucuccgcuggagacagauacggcauagucaaagcccugcaagacaaauuucucuacaaagacggaaacgacaaauaccgauucgucccgccgauaccccucgacgaguuccgaagacaggcuaaagagcaacuaagugauauucucaucagcuucaaagccaaaaacaaaguauguacgagaaacgugaacgucaccaaaaacaagggcggcgccaacagaaaggcgcagcucacaccgagagggccacuccacaacgaaacgaucuacggaagcagccucgaauacgugacaaaagaaaaugagaagauuggcucgucguucgauacagaacgaauaaccaccguaugcaaaaagaaauuccgagaugcccuggcucggcgccuagaggaguuuggcggggaccccaagaaagcauucacggggaaaaacucacccgagaaaaacccaauauggguugacgagcaccacucagaacaagucccagccaaaguacgcacgguuaccaugggacaacgauucaccggacgcaaaccaaucgacgcaacgcugaaaauagaaaaagugauagauaaacgcauacgugaaauacuacaagcccgacuggacgaguucgacgguaaagcagcaaaggcauucucaaaucucgacgagaaccccauuugguuaaacaaagaaaaagggaucgcaauuaaacgcgucaccguguccggccccgcgaacccaguaccgguaagguucaagcgagacaaagacgggaaacccaucauugaugacgccgggaaaaccauaggagcggacuucguaaccccaggaaacaaccaccacauagccauauuucgcgacaguagcggaaagcugcaggaacaucccguaucauuccuggaagcaacuauagcaaaaucucacggccuagaugucauagaucggaacuacaacaaggacgaggggugggaguuccuuuucacacucaaacagaacgaauacuuuguauucccgaacuccgaaacgggguuuaacccgcucgacuacgaccuaacagacccacgaaacuacgccgagaucagccccaaccucuaccguguacagagcauaucuaccaacgacuacuucuuuaggcaccaccuagagacaaccucagagaaaaacaauucccuauacggcaucaccuggaaacgcauccgaaacgccagcgcgcuugaaggccucgucaagguccgaauagacaauuugggccggauagucgcggucggcgaguacgacuga

SEQ ID NO: 6767 - RNA, 4200 nt, Artificial Sequence
  Cas9 variant
auggaaacacaagccaccgcccaacucaucucuggacaccuaaaaggauacccaaucuacgacuacuucgugggccuagauaucggcaccaauucuguuggcugggccguuacaaacagaaucuaugaacuacucaaguuccgcagccacaagauguggggaucacggcucuuugaagaagggcagaccgcagucguccgccgaggauucaggucaauucggcgcagacuggagcggcgaagacugcgccugaaacuucuugaagcucucuucgcggacgcuauggcccgcguugacucaacauucuucauccgacuccgggaaucgaaguaccacuacgaggacaaaaccacgggacacaaaucgaaacauaucuuguucaucgacgacaacuacacggaccaggauuacuucgccgaguacccgacaauauaccaucuccgagcggaccuaauggagaacggcacuucugacauccgaaaacuauuccuagccguccaccacauacugaaauaccgcgggaacuuuuuauacgagggcgcgacguucgacucuaauucauccuuagacaccgugcuaaagagagccuuggagcaaaucgaguuccacaucuucaacgccaccuccgaggacgcacugcauaguauacuggacaucgugaagcugcaggacaagacuaaaucugacaaagcaaaagcgaucgagucccuaguggacaccuacauaacggacaaagucgaaucauccugcacggacaaagagaaaaaggaccugcuuaaggccgauaaaaagaggcuccgcgcauucgccaaccuuaucuugggacucaacgcgaaccuuaccgaccuauucggcacgauagaagagauagaggaagacuucgucaaacugcaaaucaccggggacaccuacgaggaaaaacgagacgacuacgcgaaggucuggggcgacacaauacgaaucaucgacgacugcaaauccguauacgacuccauaauacucaugucaaucaaggaaccaggccucaccaucagccaaaguaagguaaaggcguuuaauaaacacaaagaagaccuagcgauccucaaacgguuacucaaauccgacaaguacaucuacaagaacauguuuaaggcagacgaaaaagggcuagcaaacuacguacacuauaucaagcaaggaagaaagaacgagaccggaugcuccugcgaggauuuuuacaaauacaccaaaaaggucguugagagccuaccugacucuagugacaaggcauacauucucaacgaaaucgaacuccaaaaacuucugccccuacaacggaucaaggacaacggggucaucccguaccagcuucaccuggaagaacugaaagcaauccuagagaaaugcaaagacaccuuccccuuucucaacacagucuccgacggcuucaccgucgccgagaagcugaucaagaugcuagaguuccguauccccuauuacgucgguccauuaaaccccagccacucaaucgauaaaggcggcuucgccugggucgaacgcaaggagccuggccaagucacaccauggaacuucgaagacaagauagaccgcgaaaaaucagcagaagcauucauuaaaaaccucaccaacaaaugcaccuaucucauaggcgaggacguccuucccaaaucaucccucuuauauucagaguucaugcuacuuaacgaacuaaacaaccuccgcaucgacggcaagccgcuagaacaagcggucaaaaugcaucuaaucgacgcagucuucaagaaagaacauaagaaacaaaccaagaaccgcauaauagaguuccuaaaagacaacaauuacauacuugguaagcacaaaccagaaguggaugggcuagacgaaucaaucaaaggcgaccucgccagcuaccgagacaugaaaagaauccucggcgacgacuucgacgugagcauggccgaauccauaaucacgucuaucacgauuuucggggaaaguaaaaauaugcuaagggaaacacuccgcaaaaaguucggcagcauccucagcgaagaccaaauacgcucacucgccaaacugcgcuaccgcgacugggggaggcugagcaagaaauuccucauaggaaucgacggauguguaaaaggcgaagacggcacgcccgggacaaucauagacaugaugagaaauacaucgcacaaccugauggaacuccuuggcgacacguucagcuuuauggacgucauuauagaagaaaacgacaaauugacgaaaggacagguaguagacccacacgaaaucaucgaggaacuaggccucagucccgcggugaagcgggccguuuggcaagcguuaagaauuguggacgaaguuauucacauaaagaaagcacuccccagcagaaucuucguggaagucgccaggacgaauaaggacgaaaagaaaaagaaagacucacgaaagaaaagacugcaagaacuauauaaaucgauacagaaagaaucgcccgaguggcuaucggucacgagagacgaaucagacaagcucauuagcaaccucgaccgcgccgacgacagcagccuccgcuccaagaaacucuaccucuacuacacacaaaugggacgauguauguacagcgguagagucauagaccuggaccaacucaacaccgauaaauaugacaucgaccacaucuacccgcguagcuuaaccaaagacgacucauucgauaaccucguacucugcgagcgccaggagaaugccaaaaagagcgacaacuaccccauugaccccgacauacaaaacgcgcgcaaaccauuuuggaccuuccuaaaagaccaaaaccugauauccagccgcaaauacgaacggcuaacacgcguucucccccucgaggcugacgacuuaacaggauucauagcgcggcaauuaguagaaacaaaccagaguguaaaagcagucaccacucuccuccgaagacucuaccccggggucgacgucgucuucgucaaagcugagaacguaacggacuuccggcacgacaacgacuucauaaaagugcgcagccuaaaccaccaccaccacgcaaaagaugcguaccuuaacauagucguagguaacgucuaccacgaaaaauucacgcgaaauuuccgaaaguuucuaaagaaaaacggcgccaaacgcaccuacaauuuagcacgcauguucgacuucgacgugaugucaacgaacgcgaaagauggaaaagcaugggacauuaagacgucaaugaacauagugaagaagaugauggccucgaacgacgucagggucacaaaaagacuaauggaacaaaaaggugcccuauccgacgcgaccgucuacaaggcauccguagccggcaaagcgaaaggaggagcauauauaggaaugaagacaaaggacuccgucuucucugacgucuccaaauacggaggccgcacuucaauaaagaacgcauacucaauaguaguagaguacacgggcaagaaaaacgagauaaucaaagaaaucguaccccugccuguauaccugaucaaccgaaacaaaacggaucaagaacuaauucacuacaucguaucaauaaucccgcaagccaaaaacgugagcaucaucuacaagaaacucugcaucaaccaauuaguaaaaguaaauggauuuuacuacuaccucggaggcaaaaccaacaacuacuucuggauagacagcgccauccagguaguuaucgcagacgaguggaucccauaccugaagguacuagaaaaauucgacgucaugaggaagcaaaacaaggagcucaaggucggaacggucuccaccagcauccaaaaucagggcaagaaagucguaaucaaaauccucgaagagagaaacguggaguucuucaguuaccuuguaggcaaacuacacucaagcauauacagcaaaaugaagggaaacaaggcgggagaacuggcaaccaaaagccucgaaauauucgucaauaugucacucgaaaaccagugcauuuaccuaauggaacuccugaaucuccucacaaacaagaaagcaccagacgucaaaccacucggcaucaccgcaagccgaggcaccaucgggagcaaagucuccaaccaagacgaguucaaaaucauaaacgaaucaaucacgggccuguauagcaacgaggugaccaucguauga

SEQ ID NO: 6768 - RNA, 4200 nt, Artificial Sequence
  Cas9 variant
augaaccuccguaacacaaccgacgaguacaacaucggacuggacaugggcacaaacagcguaggaugggccgugacugacaaggcgggcgccauagcccacuucaagggaaaaccaacccuagggucccgucucuucgacgcggcccaaaccgcggcgggcgcccggauacaccggagccagcgucgaagauacguaaggcgucgauggcgacuggaccuacugcaaagccucuuccaggacgaagucaguaagguagacuccgaguucuucugccgccuccgccaaucacgcuuauacgucggcgacagggaaaaaggacacgccgacuacaccuggccaauauucaacgauagcgacuucaacgaaguagacuacuacaaacgcuucccuacaauauaccaucugcgaaaauggcugauggaaacagacgaaaaagccgacauacggcuaauauaccuagcaacccacaacauaguaaagcaccgcggaaacuuccuacgcgaaaacaauaagagccucagcagccgggacgcuaacccggcacaagccgucaagagccuccgacuggcacucaacgacuggugcuccgaacgugacuacgaaugcgcauggaaaggcgaggaggacgauggugcaauagacgaagcgauccuaaacguacucgcugauggggagaaaggccggagcgaccaagcaaaagaaaucgccaagcuaacaggagucgauugcggugacgcgaagcagagcaaacaaugcaacgaagcaaucgccaaagcaauaguaggacucaaagucgaaaugaagaacaucuucggagaguucccagcagaaaagaccaguuacauauaccucuccucagacgaagacguagaagcggugcgcgaguccuguccugacgacuccggggaacuauuucaggcccucuguaaacucuacagcgcauacauauugcaggagcuccuauccuacgcagacccauccggccaaaccaucucggcaaacaugguagccaaauacaaacaauauggacgcgaucuccgucuucugaaagagcucacccgcacuuaugccccacaaaaauacgaccuguucuucaggggcgagacauacgcggggagcucagauuacguggucgaugaagcacgcggauauacaagauacaacuugggaacaacuaaagcuaacuacgacgacuuucagaaaucagugaaagaacucuucaaggggacugacgcucuacaagacgaaagauaccaagaaaugauggucgccuucggagaacaaaaauuccuaagacggcucaaaacgagugacaacggcuccaucuacuaucagcuacaccuggaagaacugcauaccauccuugaaaaccaaggcaagcauuacccauuuuugcugucggaagaagacaaaauagaaucacucguaaguuuccgaauaccguacuacgugggcccgcucacaaggaaaaacgcagccaucggccacgacgggaaggaaagauucgcauggagcuccaggaaggacggcauggaacaugcaguaaucacaccguggaacugggaagagauaaucgaccgggacaaaucugcggaggacuuuauuaugaggaugacgggagacugcacauacuugcaaggagagcccguacugcccaagugcucacuucuauacgaagaguuuugugcacucaacgaguucaacggagcgcauuggacagucgacggagaugacgaaaggagauucgaugcagcccagagagaacggauaaugugugaccucuuucggcggacacgcucagugacguacaacaaagucagcgacuggcuagaacgcaaguacaacuucacaggggcgcgaguacgaggaggccaaggcgaacacggcuucgagagcaagcucggaagcuacauauucuuuugcaaagacguauucaagaccgacgggcuggacgaagcggauuacaccaugauagaacaaaucauacucuggucaacucucuucgaagacagggacauacuaaagcgcaaaauagaggaagccuacgggggcgacagacucaccagcgaacagaucaagguaaucugcaaaaagagauucaccggauggggccgauuauccaagagauugcuaaccgacaucaaagucaauacagauaccggcaggaagucuauaauggacguauuacgagagggcaaucccaauaacggccaacgcucgagaacgaugguguucauggagguccuucgggaugaagaccucggcuuccaaaaagcaauagacggcuuaaacagagacuacuuuagagaacacaacaacggacuaauggacguaaacgaccuacccggcucgcccgcaauccgcagaagcaucaaucaggccguccgaaucgucgacgagaucgccucaauagcgcgcaaagagccaacgaacaucuucauagaagucacgagagaggaagacgacccacgaaagaaaggcaaacgcacaaaaagacgguaugacgccaucaagagcgcacuggaaaaauucaagaaagacgacccaucccucuggaaagaacugugcgagaaagccccuggagacauggacgaaagacucucccuuuacuucaugcaacgaggcaaaugcauguacuccggaaggcccaucaaaaucgaagaacuccacaccggaaaauacgaaguagaccauaucauaccaagauccuacauaaaagaugacucauucgaaaacaaggugcuagucuaucgcgaagagaaucagcacaagaccgacgcccuccugauagacagcucuauaaggcaaaagaugggcggguacuggcgcaugcuccacgaugcgaagcuagugggcgauaaaaaguuccgaaaccuauuucgaaaccacaucgacgacaaagcaaugaagggauucguagcgagacaaaucgucgagaccucacaaaugguaaaacucgugcaaacccucuucgaagcgagguaccccaauacacgcaucgucccggugaaagccggcaucagccacgaccugagagaagccgcgggacuuguaaaaugccgugaggcgaacgacuuucaccacgcacaugacgccuuccuagccugccgaauaggccuauucauucaaaagagacacccaagcguauacgacaaucccaucggacucgcacgaaucaugagggauuaugcgagaaugcaagcccgcgaguauaagaaaagucacugucuugcgcacacacaaggcuucaucgugaacucguuuuuaagcagcgguuucgaugaagaaacgggggagauauucaaagacgacugggacgcgaaagccgaagucgagggcauccggcgcguccuaaacugccgacaaugcuucauaucgcggaugccaguagaaggagacacacgcuacggcggcagauacuggggcgaaaccauauacucgcccaaagggaaacacaaacaugaaauuccacucaaacaagggcucgacccaaaucuguacggaggcuacuccgaucuccuauacagcuauuuccucauauacgaggcaucagacguaaguagcggggaacgcguccuacgguucauaggcauuccaacaucgauagccgcgcgcauggcaaaccaaaaacgccucgaggaauacguaagucgauuagcccugcaggagaaucuagagcacguaaggaugguacgcaagaucaugaagaaacagcugauagaaguagacaacugucgccugcuugucaccgcagccgaugccguuaccaacgccacugaauuagccuucagccucgacgaaaugaaaaucaucucaaccugcgcaaaaugcaucaacggggcggaccccucggcaaucgacaaaaucgggaacgcgcaagacuccuucuucgacaaccuaaaacggcgagggagcgaccggugcgcccuccuauucucacaacuaaaacucgauaaacugucucagaacuuuuacaugaucagcucagacgacaaaagcaagauccugaucagcauacuagaccgcauccgcgcaaagagcaauagcgucgaccuaucacugguaggcggagcaaaacacgcagcccaaaugaaguucgacuucaacgccaaacucaacaaucccgcauccuccuucguauuaaucgaccagagcgugaccggcauguucgaaaggaggacaagaauaggccucuga

SEQ ID NO: 6769 - RNA, 4203 nt, Artificial Sequence
  Cas9 variant
augaaccugcguaacgcuaccggcgacuauagcauaggucucgaccucggcacgaacucagugggcugggcggugaccgauagcaacggcagcauggcucacuucaaaggaaagcccacccucgggucacggcuauucgaugccgccgagacagccgcgggugcacgccaacaccgaggacagcgcaggagauacgucagacgacgcuggagauuagaccuacugcagggacuuuuccaggaugagguaaacaaaguagacucagaguucuucauucgccugagacaaagccgacuccacguggaagaccgcgcagaaggacacgccggcuaccgauggccccuauucaacgacacagacuucaccgaaaaagacuacuacaaacgcuuccccacaaucuaccaucuacgaaaauggcucauggaaacagacgaaaaggcagacaucagacucauauaccuugccgcccauaauauagucaaacaccgcggcaacuuccuccgagaggacaacaaaaaccucagcucccacaacgcaaaccccgccgaagccgugcgaucacuaagacaagcucuagacgacuggugugcagaacgcgguuacgugugcgccuggacauccguugacgaccucgcagaggccgacagccauauccucgacauccucacuaacuccaaagaacgccgagcggaccaagccaaagagcucgcaaaacuguucggaguugacugcggggacaccaaacaaucgaagucaugcaacuccgccuuagccaaagcaguggucggauugaaaaccgaacucaaagacgucuucggugaauuuugugccgagaaaacugcaauccaccucucauccgaugacgacguugaggccauacgggacgcaauaccagacgacagcggcgaacuauuccaaguguugugcgcaguauacagcgcauacguacuucaagaacuacucagcuacgcacccggacaaacgauaucagcuaacaugguagccaaauacgaccaauacggcaaagaccucaaacuccugaaaaaccuagcaaggacauacguauccagagagaacuacgaugcauucuucagaggccaaacguacgaagacaguaaugacuacaacguagauaaagcacaaggauauaccagauacaaucuaggcacaacgaaagccuccuacgacgacuucaagaaaucaguggagaagcuauucaaaggcacccaagccgagcaagacaagcgauaccaaggaaugaugaaaagauucgccgaagagaaauuccuacgaagacugaaaacgucggauaacggcaguaucuacuaccaacuccaccuagaggaauuaagagcgauccucaagaaucagggaaaacaccacccguuccugcuggaggaagagaagaaaaucgaaucgcucgucagcuucagaaucccguacuaugucgguccacucuccagcaaaaacgccucgcucgaccacaagggcaaacaacgcuuugcguggagugaacgaaggcccgggaugaaagauaccguaaucacgcccuggaacugggaccaaaucauagacugugaccaaucagcagaaaaauucauacucagaaugacaggagauugcacguaccuccaaggcgagcccguccucccgaagugcagccuacucuacgaagaauacugcguccugaacgaacucaacggagcccgguggacaauagacggcgacgacuggcgacgcuucgacguagcccaacgcgaggggauacuccacgaucucuuccgaaagacccgcuccguagcauacaacaaaguggccgacuggcuagagagagaggagaauugggcgaaugcacacguacgagguggacaaggugaaaacuccuucgaaucaaaacucggcagcuacaucuucuuuugcaaggacgucuucaaaacugcggcccuagacgaagccgacuaucccaugauagaacagauaauccuauggaacacgcuuuucgaagaccgagccauacucaaacgcaaaauagaacaggcguacggcgaacaccacggaggcaaauugacugacgagcagauaaaagugauuuguaagaaacgauucaccggauggggccgguuaagccggaaacugcuaacaggaauaaaaguagaugccgacacuggccgcgucucaaucauggacguacucagggaagggaaccccaacgaaggacagcggagccgcacgaugguccucauggagguccucagggaugaagaucucggauuccaaaagaaaaucgacgacuucaacaaagccuacuucgcaggacaaggagagggucucaugucaguuaacgauuuaccuggaucacccgcaauccgcagaucgauaaaccaagcgauccgaaucguagacgaaauagcgagcaucgcgggaaaagcaccuagcaacgucuucaucgaagugacgcgcgaagaagacgacccacgaaagaaaggcagacgcacgaaucgucgcuacgaagacauuaaaaacgcacucgaaaacuuuaaaacggaggaucaagagcuaugguccgaacucuugggaaaagccccaaaugaccuggacgagcgacugucccuauauuuuaugcaacgcgguaaaugcauguacagcggccggccgauaaaacuagaggaacuccauacagggaaauacgaagucgaccacauaauaccgcgcagcuacaucaaagaugacaguuuugaaaacaaaguauuaguaugccgagaagagaaccagcgaaaaacaaacgaaaugcucauagacccagccauaagaagacgcaugggugauuacuggcgcaugcugcacaaagccaaacuaauaggagacaaaaaguucaacaaucuguucaugcgcgaccgaaucgacgacaagacuuuaaagggguucguagcgagacagcuagucgagaccucacaguccguaaagcuaguccaaacccuacuugaagugcgcuaccccaacacaaaaaucguccccgugaaggccaacaucagccaugaccugcgcgaagcugcugaucuagugaaaugcagagaagccaacgauuuccaucacgcucacgacgcguaccuugcauguaggguaggcuuguucauccaaaagagacacccauccguauacgcaaaucccaucggacuaucgcgcgugaugcgagacuacgcccgaaaacaagcaggcgaguucaauaaaacacacagcauggcccacaccaaaggauucauugucaacagcuucaugacuagcgaauuugacaaggaaacuggggagaucuucugggacgccgaggcagccgucgaggacauccgccggguccucaauuaccggcaaugcuucauuucuagaaugcccgucgaggacacaggcgcauucugggaccagaccauauacaguccacgaagcaacaaacgacuagaacuaccacuaaaggacgaucucgacccgaacaaauacgggucauacagccgcgaacaguucgcguauuucuucaucuacgaagccagagacgccaaaaagagcaaaacgguacuccgauucgcacaaguccccguccgcgugaccagugcaauagcccgagacucuagcaaguuggacgaauacgcgagcggacuggcggugcaggaaggacucgaguucaccaagaucaucaggcgacgaauacuaaagaagcagcuccucgaauuaaacggagaccgccuagucauaacgggcgcaaaagaggugcgcaaugccacggaguucgcauucacccucgaagaaaccgcgcuuguagcgaugugcagcgaaauagcccgggaaggcgucccgagcgaaaucgcaucagacgugcagucaaucuccucccaacuauccgaccuauuccucgcccucauugagcgcgggcuaaccaucggcgugagacuacauggccaacuaaaacucggacaguaccuccgccaguucgaggaugccgcucuccgcgacaaggcaaaggucaucaucggaaucauaucuaucaccaacggagcaacaaauacccuagaccuaucaucacucaacggcuccaaaaacguaggacaaguucgaauaacccacaacaaacuccucaaugacaaaagcaccagcuauguacuaaucgaccagaguguaacggggauguucgagagacgaacccgaaucggccucuga

SEQ ID NO: 6770 - RNA, 4203 nt, Artificial Sequence
  Cas9 variant
augaaaaccauaaccgaagacuacauccuuggccucgacaucggcacaaacucaugcgggugggccgucauggauaagaaaaaccgacugcuacgccuccggggcaagagggcaaucgggucucaccucuucgaggaaggccacuccgcggccgacaggcgcaguuuccgaacaacgcgccgccggcuaaaacgcagaaaauggcgccuccgccuccucgaggaguucuucgccgaaccaauggcaaaaguagacccagccuucuuuguccgccuccaucaauccuggguaucaccacuagacaaagaccgcaagaaauaccacgcaauuguguucccgaccgcuaaagaagaccacgaguucuaccacgauuacccaacaauauaucaccucagagacgcccugaugcgagaagacaggcaguucgaccuccgagaaaucuuccuggcgauccaccauaucguaaaauaccggggaaacuuuuugcaagacaccccaguaaauaguuucguagccucaaaaaucgacguugccucauuccuaacgaacgucaaccaagccuacgcagacaaguacggcgaggaacaaaacuucaucgaacuaaaugaaaacaacgcggcggccauagaggcaguaauccgagggaaagacaaggacaagacgaccaaacaauuagacaaagccaagaaaauaaccaaacuacugcaauccaguacaaacaaauacgagaagaacguaacccggcaaauugcaaacgcaaucaucggcuacaaaacccaauucgagaccauccucggcaaggacaucgacaaaaacgacaaggcagacugggaguucaaacucagcgacggcgacgcagacgacaagcuggagaaccuacugccagaguucgacgauaacgaccaauauaucguugccgaaauuaagaaacucuucggaagcauagcacuuucccaaaucguauacgagaacaugacccugagucagagcaugaaauguaaauacaaagaccacggcgaagacuacgaccuacuaaagcaauauaucgccacccuaucagaccacucccagguccggaaacuccuacucgccuacgacuuguauguaaacaauagacacggacgccuccuagaagccaagaaagaguucaaacaagacaaggcgcugacacaagacgaguucuauaaaauagucaaagagaaccuagacgacucccaacuagcccaaaagauccugcagaagauugacgaaggcaaguucaugccaaagcaacgggucaacaaaaacgguuacauaccauaccaacuccaccaaaucgagcuggaccagauaaucgcgaaucaaucaaaauacuauccuuuccucgcggaagaaaacccagucaaagagcauagaaagcaggcccccuauaaacucgacgaauuaguacgcuucagagugccguacuacgucggaccucuaauaagcccagacgacaagcgaaaggaugagcaacagaacaaaaaccaugagauguucaaguuugccuggaugaaaagaaaagaugacaauggugcaauaacgcccuggaacuucgcccagaaagucgaccgggagaccagcgccaaucgauucauaaaacgcaugaccgucaaagauacauaccucaucggcgaggacgugcuucccgcccguucccuucuauaccaaaaauucgaggugcuaaacgaacucaacaacauuagaguuaacgggaaacgacuggaacccaaguucaaacaaaagguauucaacgagcuauucaagcagaagaauaaagucaccaaaaaggcuuucaaagaguucauccuccaaaacacaggaaugaaaaccgcagaaauagauggucuggccgacccaaccaaauucaacaguagccucucguccuacuaucaccucaaaucgaccaaaguauucgacaaacaacucgacgacccccaauaucaagcugacuucgagaaaaucauagaauacuccuccauauucgaagacgccgaaauauaccaagaaaaacuccacaaggaaaucaaauggcugacuccggcucaauucaaggcaaucgccaacuggaggcuccaagggugggggaggcuaagcaggaagcuccugguagagcucaaaggcaaagguggagaaaacauaauuuaucaacuauggaccacccagaaaaacuuuaugcaaaucgugaacgaacccgagcucaaaaaggccaucgugaaagaaaaccaccaagcuaccgaagagaagggaauugagaaaauacuugacgacucauucacaucccccgcaaacaagaaagccauuagacaaguuauaaaaguggucgacgacguggucaaggcagcaggaggaaagaagcccgcacaauucgcuauagaauuuacacgcgaaccaaaguggaacccccaccuaagcaacauacguggaacgaagcuccugcaagucuacgaggacacagccaagaagcucgucgaucaaucgcuuacggacucccugagagaaaacaugacaaaccgaaaccuccugaaagacgaauacuuccucuacuuuauccaaggcggucgagacgcuuauaccgguaagaaaaucgacaucgacgacauacccaaaaaguaccaaaucgaucacauacuuccacaaucguucaucaccgacgacucccuagauaaccgagugcucacagagaucgaaaucaaccaaaagaaaggcaagaaauacgcaucacaccuauucgccccaaaaccggccuucggccugaaucaaucgaucagugaaauguggaaaaccuggcaaaaagcaggacugaucagccaacguaaacucaacaaucuacucuucgauccagaccucguaaaagacaaacagaagaaaggcuucauuaaccgucaguugguugagaccagucaaauaaucaagcuagucucgaucauccugcaagacaaauuccccgacaccgaaauaaucacugucaaagccggcuauaauaccgcacugagaaaagaacuaaaacuauacaaaucaagggaggccaacgacuaccaccacgcaaucgacgccuauuuaacagcuauaugcgauaauuuccucuaucaggucuacccgaacuucaggccuuucuucguuuauggucaauucaagaaguucucucaagacacugauaagcaaaagaaggccgucaaauacuacggccucaagaauuuccuccuuccccuacuagacgacucaacgggggacgaagucauggucaaucacaccaaacacguaguguuccacaagcaacgcgacaucuucaaccggcuaauccaggcauauaacuacaaauacauguuggucagccgugaaacaaccacugaaaacuccaacauguucaacaugacaaucuacccgaggggcgaacgggaccgcaagaaaacccgaaaacuuauccccaaaggaaaagaccucgaucccgccaucuacggcggcuacuccggcaauacagacgcauacauggucaucguuaaaauagagaaaaccaaagaaacacuauacaaaguugucggaguacccaugagggcccuggccagccucaaaaaggcacaaaaggaaggaaacuacgaccaagaauuaaacaaagucuuagaaccccuaauaauguucaauaagaacggcaaaagcaaggcgggcaucaagggguucaccguaguaaaagaccacguacacuucaaacaggucguaaucgauggagacagcaaauucaugcucuacuccgcccaauaccgcgcgaacgccaaacagcucacccucagccaagagaccaugaaaguagucacagacaacaccgacgauauggaccaaaagaacgcagacaaggaccaauuacugcucaaugcauacgacgaaaucuuagaaaagguagaccaguaccucccacuguucgacaucaacggcuuucgacaggggcuccacgacggcagagccaaauuugccgcccucaagacaagugaaaagaaauacacgcucaaaaauguccugaauggccugcacgacaaccuggugacaccaaaccucaaaaauaucgggauaaaaacgccauuuggucucaugcaauccucauccgguauaacacuaagcccgaacgcuaagcuaguauuccaaucaccgacuggccucuucgagaaaagggucaaacugacgaauuuguga

SEQ ID NO: 6771 - RNA, 4203 nt, Artificial Sequence
  Cas9 variant
augggaaaacaaaaauucaacgacuacuaccuuggauuugacaucggcacuaacuccgccggaugggcuguuaccgaucuccaauacaaacuccuccgguucaacaagaaagacauguggggcuccagacuguucgacgaagcgcagacaagcaaagaacgacgcguauacaggaacagccgccgacgccuggaccgacgcaagaaacgacucaaacuccuagaagaacuauuccuagacgaaaucucgaaaaucgacaacacguuuuucaaaagacucaaagaauccaaccuguauaacgaagacaaaagcaucaaauucaacuacccucucuucaacgacaaagacuauacugauaucgacuucuacaacgaauauaaaaccaucuaccaccuccgcaaagaccuaaucuucgaagacaagaaauucgauauaaggcucguauucauagcacuccaccacauacugaaauaucgaggccauuucaucuucgaggggcaaucguuugaagaaauaaagagcuucgacucaauauucacucaacuaaguagcuacuuucuagaaaauuucgacuucaacaucgaugucuccauuaaagagaaacuagaagaaauaauacuguccgacaacacaaaaucaauaaagaaaacggaguucaagaaaaucuucuccgauaacaaaguccucagcguucucaacauggcgaucggauccaaagucucauuaaaagacguauuuaacaaugaggagcucaaggaacagaaaaucucauucagcgaaauagacuacgagaacgagaaaagggacgaauuuuaucaacuccucggcgaggacauuuucuuaauagaccucgccaagaaaauauaugacuucaugguacucaagaaaauacucaaaaacacggacucguucagcgccucgaaagucgcccuauacugcgagcauaagaaagaccucgaugaccucaaauauauauucaagaaauaccuaacaaaagaagacuacuucaaguucuuccgaucuaauguggagaagaucaacuauccaucguacauaggucucaauaaaauaaaaagcaaaaagaucaucaaagaaaacaagugcuccaucucagacaucaauaaagaacucaaaaacaaauaccugaaggauauaaagcucgaagccaaggacaaagagcuauuuaaccggauauucaacaagcucgacgaauuuaaguuccucgagaaacucaaaagcagcgaaaacagcaccguaccguaccagguccacgagaucgagcugaagaagaucuuagacaaccaaagaaaguauuaccccuuucugaacgagaaaaucgacgggaagagugucuacgaaaagaucauccagcuauucgaguucaagauuccguacuacaucgguccucugaauacggacccuaacgugaaaggcaaaaacaccugggugguacgcaaagacgaaaacaauaagacgccaauaacgccguggaacuucgagcaaaaggucgauaugcagaaaagcgcagaagaguuuauaaagcgcaugaccaaccgcugcacauaccuaaaagcagaagacgucauagccaaaaacucccugcucuacgaagaguucauccucuuaaacgagcucaauaagguaaccguugauaacgaaauccuacacccgacccugaaaacagaaaucaucaacgaacuauucaagacuaccguaaaagucacaaagaaaaaguucaucgaguuccugaaaaagaagcaagccguaaacgaugucgaaucaauaaccggcauaggggucgaguucaacugcaagcuccaagguuacaauacauucagaaagauccuagguaagaaaaucgagaacgucaacgucaaaaacuucguggaaaagugcaucgaacuaaagugccuauauggauccgacaagaaacuauucgagaacgccaucggaaagauuuaucgcgaauacaacauaacggacgaagaauuuaacaagaucaaccgccucaacuucaacaagugggcgcgacuuuccaaaaaguuccucacggaaauuucguucgagaaaaccgacggaaccaagcgcuuugagagugucauagaagcucuccgaucaacgaacuacaaccucauggagcugcuauccgacaaauucaacuugcaauccaaaauagacgaaauaaacggcgaagacgacuuuucuaauaucgacauaaaggaauacguggacaaacucuacguaagccccucggucaaacgcagcauaauccagacauacaagauugccauggagaucaagaaaaucaccaaaaaggacccaaagaaaaucuucauagaaauggccaaagacaaaggagaaaaaggcaaaacaaccgaaaaacgcaaagacaaaaucaaaaagcucuacaagaauaucaaagacacccucuccgacuacugcaacaaucuccaggaccuuacacuccaaguugagaaguaugacgacaaccgccuccgccagaagaaacucuuccuauacuucaugcagaugggaaaaaguauguauaccggaagauguauugaccuagaagaccuauucaacaacaacguguacgacauagaccacaucuacccacagagcaaagucaaagacgacuccuucgacaauauaguacugguagagaaagaagagaaccacagaaaaucgaaugaacugcucaaggaagagauccaaagccgaaugaauaacuacuggauauuccuccgcgaaaacaaguucaucuccaaagaaaaguacaacagacucacccgcaaaaaggacuuuaccgacgaagaacuaggcgacuucguggcccgccaacucgugacgacucgccaaagcaccaaggaaaucgcaaaauucuuugagaaaaucuucgagaaaacaaccguagucuauagcaaagcaucgcucguaucugaguuccgagaaaaguacgacaucaucaaaguaagagaagugaacgacgcccaucacgcacaggacgccuacuuaaacauagucgucgggaacguauucaacaccaaguucacuaagaauuacuggaaauucacaaaagacauaaagcgacaaaacgaagagaauccaaacgagaagaaaggguacaaccuacggaaaauuuacgaauccgacgucuucugcaacgacuccguggccuggguauacuccaaagaaaaccccaaguacaacacuaucaauaccgugaaagacaugguuuaucggaaaacugcaaacaucacgcgcaugcuaguggaaggcaaaggccaauuauucaaccucacaaucaaagacaaaacacagcuaaagaagaacgugggaaacauagucgccaacacgccaauaucccugaagaacagaaagcuccaccugaacuccguugaaaucgccaagaaauacggguacuucgacucucuaaacaacgccuauuucguccuguucaaauacgaagagaaaggcaaagagaaaauuggauucgauagcauuacaauagcguacaaagaacggcugaagaagaaccucgacauugaaaaguuucuagaaaacaagggcuauaaaaacucaaagcugauccgcaaaaucuucaaaaaccaaaaaguccuaauaaacggauacccguaccuccugaaguccuucaacaaacaaucacaaauaaaauucaacaacuuuaagauucuguaccuaaacgaaaacaaccucaaguuugccaaagaugccaucaaguuugagaagaacaaugccaacguagaccucaagaagcagaaauauaucgucagcuuccuaaagaagaagaaacagaacgagauaaacgagaccuaugaggagugcauagaccgccucaacgacgaguucgacacucucuuccugaaacugugcgauauccagaaaagcaguaucuacacuaacuauaaauuacaagacuucagcaguaauaagaagucaaucgagaucaaagauaaguucgacaucuucaagagcuuagaccucuacaagaaaagcaagcucauaaaagaguucuugaacuacuacaaguaugagaagaacgacuuggacuucucgcugauugacauagacaaaaaggcaaacugcauacaaaaacacuucacggaagaccucgucaaagacuucguaaucgucgacgaaagcgugacaggccucuuugugaagaaagaacggcucaaauga

SEQ ID NO: 6772 - RNA, 4203 nt, Artificial Sequence
  Cas9 variant
augaaaacaaucaccgaagacuacauccugggacuagacauaggcacaaauucaugcggcugggcaguaauggacaagaaaaaccgccuccucagacuaagagggaaacgagccaucgguagccaccucuucgaagaaggacacucugcagccgaccgcaggagcuuuaggacuacgcgccgacgacuaaaacgccgaaaauggcgccucaggcuccucgaagagauauucgccgaacccauggccaaaguggaucccgccuucuucguccgccuacaucaauccuggguauccccuuuagacaaggaccguaaaaaguaccacgcaaucguauuucccaccgccaaagaagaucacgaguucuaccacgacuaccccacgauauaccaccuacgugacgcccuaaugcgcgaagacaggcaguucgaccucagagagauuuuccuugcaauacaccacaucguaaaauaccggggcaacuuccuccaagauacucccguaaauucauucguagccuccaaaaucgacguagcgagcuuccuuaccaacguuaaccaggcauacgccgacaaauacggcgaggaacaaaauuucaucgaacuaaacgaaaacaacgccgcugccaucgaagcaguaauacggggcaaagacaaggacaagacuacgaagcaacucgacaaagcgaagaaaauaacaaaacuacuccagagcagcacgaacaaauacgagaaaaacgucacacgacagaucgcgaacgccaucauaggcuacaaaacacaguucgaaacaauacuuggaaaagauaucgacaaaaacgacaaagccgacugggaguucaaacucuccgacggagacgcugacgacaaguuagaaaaccuccuccccgaguucgacgauaacgaccaauacauaguggccgaaauaaagaaacucuucggaucgaucgcccucucccaaauagucuaugaaaauaugacgcuaucucaaaguaugaaaugcaaguacaaagaccacggagaugacuaucaccuacuaaagcaauauauugccacucuauccgaccacggacaggucaggaaacugcuacucgcauaugaccuauacgucaauaaucgacacggucgccugcuagaagcgaagaaagaguucaaacaagacaaagcacucacccaagacgaguucuauaaaaucguccgcgaaaaccucgacaauucgcagcuagcucaaaagauccuccaaaagauagaagaagagaaauucaugccaaaacagcgcgucaacaagaacggcuucauccccuaccaacuacaccagauagaacuagaccaaauaauagccaaccaauccaaguacuacccauuucuagcagaagagaaccccgucaaagaacaccguaagcaagcgccauacaagcuggacgagcuaguucgauuccgaguuccuuauuacguggggccucucauauccccugacgacaagcggaaagacaaacagcagaacaagaaucacgaaauguucaaguuugccuggaugaaaaggaaggauaacaacggagcaaucaccccauggaacuucgcucaaaaaguagaccgggagaccuccgccaaccgcuucauaaaaagaaugacaguaaaagauaccuaccucaucggcgaagacguccuacccgcacggucgcuccucuaucaaaaguucgaaguauugaacgagcugaacaacauccgagugaacggaaaacgccucgaaccgaaauucaaacaaaaaguauucaacgaacucuucaaacagaaaaacaaggugaccaaaaaggccuucaaagaguucauccuacaaaacacaggcaugaagacagccgaaauagacggacucgcagaccccacuaaauucaacucgucacucuccagcuacuaccacuuaaaguccacaaagguuuucgacaaacaacuggacgaccccgaauaccaagccgacuucgaaaagauaaucgaauauagcucgaucuucgaagacgcagaaauauaccaagagaaauuacacaaggaaauaaaauggcucauaccagcacaguucaaagcgauugcgaacuggcgcuuacagggcuggggacgccuuuccagaaaacugcuggucgagcucaaaggaaagggcggcgaaaacauuaucuaccaacuauggacaacacagaaaaacuucaugcagauagucaacgagccugagcugaaaaaggcaauuguuaaagaaaaccaccaggccacagaagaaaagggcauagagaagauccucgacgauucauucacaagccccgcgaacaagaaagcgaucaggcaagugaucaaaguggucgacgacgucguaaaagccgccggcgggaaaaagcccgcacaauucgccaucgaguucacccgagaaccgaaauggaacccgcagcucucccacaucaggggaacgaaacuacuccaagucuacgaagauacggcaaagaagcuggucgaucagagccugaccgauaguuuaaaggagaauaugacgaaccgcaaccuacugaaagaugaguacuuccucuacuucauacagugcggccgggaugcauauacaggaaagaaaauugauaucgccgacauucacaagaaauaucagauagaccacauacuaccacagucauucauaacagaugauagccucgacaacagaguacuaaccgaaaucgagaucaaccagaagaaacacaagaaauaugccagccaccucuucgccaccaaaccagcguucggucugaaccaauccauauccgagauguggaaaaccuggcaaaaagccgggcuuauaagccaaagaaaacuaaacaaccuccuguucgaccccgaccucguaaaagacaagcaaaagaaaggcuuuaucaaucgccagcucguagagaccucacagaucauaaaacucgucagcaucauccuacaagauaaauucccagacaccgaaaucauaacugugaaagccggauacaauacugcacuccggaaagaacucaaacucuauaaaucgagggaagccaacgacuaccaucacgccaucgacgcauaccuaacugcaauaaacgacaauuuccuguaccaagucuaccccaacuuccgccccuucuucguguauggccaguucaaaaaguucucccaagacacggacaagcaaaaagaagccauuaaauauuacggucuuaagaacuucuuggaaccacuacuggacgacagcacgggagaugaaguaauggucaaccacacaaaacacgucgucuuucacaaacagcgagacauauucaacagacucauucaggcuuacaacuauaaauauaugcucguaucgcgggaaaccaccacagagaacagcaauauguucaauaugacgauuuacccuagaggcgagcgcgauagaaagaaaacccgcaaacucauccccaagggcaaggaccuugacccugccaucuacggcgguuacagcggcaacacggacgccuacaugguaaucguaaaaaucgagaaaacgaaggaaacgcuuuacaaagugguagggguacccaugcgcgcgcucgccagccuuaagaaagcacaaaaagaaggcaacuacgaccaggaacucaacaagguccucgagccgcuaaucauguucaacaaaaacggcaaaagcaaagcgggcauaaagggauucacggucguaaaggaccauguacacuucaaacaagucgucaucgauggcgacuccaaauucaugcucuacucagcacaguaccgcgccaacgcaaagcaacuuacccuaagccaagaaacaaugaaggucgugaccgacaacaccgaugacauggaccagaagaacgcagacaaagaccaacuccugcucaacgcauaugacgagauacuagagaaggucgaucaauaccugccacuauuugacauuaacggcuuccgacagggcuuacacgacggacgcgccaaguucgcagcccucaaaaccucagagaagaaauacacccucaaaaacauucuaaacggccuccacgacaacuugguaacacccaaccuuaaaaacauuggaaucaagacaccauucggucuaaugcagucuucgucaggaauaacacucucucccaaugcaaagcuagucuuccaaagcccaaccggccuauucgaaaaacgaguaaaacucacaaaccuuuga

SEQ ID NO: 6773 - RNA, 4203 nt, Artificial Sequence
  Cas9 variant
augaagacaaucuugggacuugacuuaggaaccaauagcaucggaugggcccucguuaaagaaacugaaaacagcaaugaaaagagugagauaaucaaacuaggagucagagucaacccucuaacagucgacgagaaaaccaauuucgaagcaggacgcccacuaaguacgaacgccgaccgaacagccaaacgaagugcccgccgcaaccuccaacgcuacaagcuccgacgcaagaaccucauagaucuacucaucaaacaccgcuugaucgacaaagacaccccauugaccgaaaucggcaaaaacacaacacaccaaacucuagaacuaagagccaaggcagcccgcgaacgaaucgagcucgaagaccuggcccgagucuuccucgcgaucaacaagaaaagagguuaccggagcagccgcaagguuaacaaugaagaagagggucaggucgucgacggaauggccguagccaagaagcucuacgacgaaaaccuuacacccggccaauacgcguacgagcuccucagcaaaggcaagaaauacguccccgacuucuauagguccgaccuacaggcagaguucgacucuauaugggaauaccaaaaacaauucuaugccgacauauuagaugacgaacucuacaacgcccuaaaaggucaggggcagcaaaauucccgcaaacgauuccuagccauaaaaggagucuacacagccgaaaacaaagggaaaagggacgaagucaagcugcaacacuacaaauggagaagcgaagcaauaacccagaagcugucaaucgaagaaguagcauacgugcuaguggagaucaacaacgaucucaacaagagcuccggcuaccugggagcgaucuccgaucgguccaaggaacucuauuucaacaaagaaacaguaggggaaaaccuguggaagcaaauccaaaagaacccacacacaagccucaaaaaccaagucuucuaccgccaagacuacuuggacgaauuugagcagauaugggaaacgcaagcacaauuccacccacaacucacacucgcucugaaagaacaaauccgggacgugguaaucuucuaucaaagaaaacucaaaucacagaaaggccuccuuagcuuuugucaguuugagucaugggaaauugaacgaaaagaugaaaacggaaacgugauccucaacaaaacgacccagcuaccaaaacgccaaaccgucggccgccgagucgcaccgaaaagcagucccuuguuccaagaguucaaaauauggcagaacaucaacaaccucgaaaucgcgaagauuuccgacggcaauagcaagaacaagaaagaaaccgaagcacuaagugacgacgaaagaaagcuccuguucgaggaacuaaaccuucgcggcaacuugucccaaaaagaagugcugcagauacucgguuuaaaagacaaagaauacaagacgaacuuccccgaaggacuagaaggaaacaggacgaacgccgcccuguucaacauauaucagcaaauagcggaaaacgaaggauacggcgauuggacaaagaaguccgcccaagagauuaaggaggaacuaaaagcggucuucccgcagauaggaauccaagccgacauacuugacuucaacgcagaacuagacgggaaagaguucgaaaaccaggcauccuaccaacucuggcaccuccucuauuccgccgaagaagacgacaagaucaacgaagaagaucaaauaauauacgggaacagcgcagucucacucaagaagaaacucugugaaaaauucggcuucacccccgaauacgccaaauggaucgcuaacgugaguuuacaagacgacuacggcaaccugagcaccaaagccaugcgcaaaauaaucccauaccuaauugacggaaaugacuacuccgaagccugcgcccuagcuggcuacaaccacagcaacucgcucacaaaggaagaaaacgacaaccgcgaacggcugaacaaacuugaacuguuaccaaagaacagccuccguaacccggucguagagaaaauccugaaccagauggucaacguggucaaccaagucauugaaacauauggcaagccggacgaaguucgcaucgaacucgcccgcgaacucaaaaagagugccgaagaaagagcagaaaugaccaaaggaaucaacgaagccacacgucgcaaugaagauaucaaaaagcuaauaaccaaaaacuucggaauccccaacccaacgaaaaacgacguaguccgcuaccgacugugggaagaacuggccccucuggcguauaaagacgucuucaccggccgacaaaucaagaaggaagaccuauucucaucgaaaauagacaucgagcacauaaucccaaaagcgcuacucuucgacgacucauucuccaacaaaacccuggccuucagagagacaaaccuaaagaaagcagaccgcacagcauauggcuucaucgagucagacuacaaugccacacuagacgacuacauacagagagucgagacacuguacaauaacgcgaaagggaccauaucaaaggggaaaagaaacaaacuccugauggcccagaaaaaccuaccagacggauucauagaacgagaccuccgaaacagccaauacaucgccaaaaaggccaagagcaugaucgaaaaaguauucaacgacgucaaugucacaucgggcagcauaacugaccggcucagggaggauugggaccugaucaacguaaugaaagaacucaacuuucccaaauauaaagcgcucggccucaccgaaaucgaagaaagguacgauauagggcaagagaaaacgaaaaaggucgaggucaucacggacuggaccaagcguaacgaccaccgccaccacgcaauggaugcccucacgguggcauucaccacaaaaucccacguacaguaccucaacaaccuaaacacaauccauagccucaaaggugacgaagucgaccucgaacucuccaaacuuuacggccucaagaauacaauuacggaggucgugaauaagaaacgaaaauucaucccaccuaugcccaacuuccgugaggaagcuaagaaacacauagaaacaauccucgucucaaucaagaacaagaacaaagucuauaccaaaaacauaaauaaaaccaagaaagagucgggauaccauacuaaagaacaauugacaccacgaggccaacuacauaaagagaccgucuacgggaagucaaaaaggccaaugaacaaaccaacaaagaucaacaaaaacuucagccuugaacaggcccaacucauaaucaacguacaagaaaaagagcuggugcuaaggcaccucgcacaguucgacaacaacccugcagucgccuucgacaccaagacacugaaaaagaugccgcuccucaaaaacggagaaccccucaaggaaguacuauguuucgaagaaauauucaccauacggaaagacaucacaccagaccucaagaucgagaaagucguagacgagaaaaucaaggccauucucgaacaacggaaaaaggacuucgggggaaacgccaaagaggcauucuccgacuuagacaaaaaccccaucuggcugaacaaagagaagggcauaugcaucaagagagucaccaucacggggguaagcaacgccgaagcccuacaucaccaaaaagaccaucucgggcgcgagauccuagacgacaacggaaacccgaucccggcugacuucgucagcacgggcaacaaucaucacguggcgauuuacgaggacgagaaaggaaagcuccaagaaaaaguagucucacuauacgaagccgucgcgcgcgcgaaccaaggccucccaguaguggacaaaggacugaacgaagauuuaggcuggaaguuccuguucacaaugaagcaaaaugaaauguucguauucccaaaugacgacuucgaugucaacgacaucgacuugcucgacgagaacaacgccaaaauaauaagccagcaccuauuccgaguccaaaaacuggcgacgaaaaacuacauguuccggcaccaccuggagacaaacguacaagaggucaaggaacucaacgacaucgccuacaagucaauccggaguaccgaaccgcuaaagaacaucaaaaaggugcgaaucaaccacaucggaaaaaucguacaggucggagaauacuga

SEQ ID NO: 6774 - RNA, 4209 nt, Artificial Sequence
  Cas9 variant
auggcgaagaaagacuacacaaucggccuagacaucggcacaaacuccguagguugggcuauaauugacgauaaccugaaacuccucaaacgcaacaugacaauaaagggaaauaccgacaaaaaguccguaaaacgggaccucuggggcagccugcuauauagcggaaauagcgacaaaacaaccagcgcagcagacgcccggucgaagcgagggcuucggagacgccuccguagacgaaaauacagacucgaccggcugaaacaaaucuuuucagaaaucaucaaugauaaagcccccaacuuuuucgacaaacuaaacgagucguuucucaacccaaaggacaagaaauacggaaaauaucagaucuucgacacagaaaaagaggaaaaggacuauuaccggagguaccccaccaucuaccaccuccgcaaagaccugaucgaauccagcaaaaagcaagacauaagacucgucuaccuagcucuagcccacauccuaaaaagcagagggaacuuccuguucgaagggaacaucgacgaucucaagaacgacuucgccggcauauacgaagagguaguggaacuaugcaugaccaucaacgcagaagacgucgacuuggaguucgaggagguagacaaacaaucccuaaacuccaucauaaagaacgaagauaucucagaaaucgaacagggacuagaaaacuucgccgacgaacacguaauauucaaagaacaaaacaaaaagaaaaacgaccucuuuagcaacugcuguaaaaucaucuguggccacaccgucaaagccaacaaauucgccagcgagcuagacagcgaacuguucauuagcuucaaaagcgacgacuacguugacgugauagaugugauccaauccgggaacgagaacaucgcaaaccuacugcuggcguguagaaaggcauacgacuacauaauguucaaccgacucgucgaccuaaacauagacucucccgccaaacucucaagcaacaugguaucacucuacaaccagcacgaaaaggaccucaaggccuacaagaaacucaucaaagaguucaacaaauucaaaaggucaaacggaugcaaagaccucgaaaugaucauccucaccgcagacgacauugacagcuuccggaagaaaguggacaaaaaggaaggaaaacucaaugggauaaauaagaaaauaacacaugagcaggcccuuaagaaacagcucaaagauaugaagaaaauacuugaagacaaaaacacagaagccgaagacaaacaaauaaacgacauucuaaaaaugaucacgucaauagaagaacgcgucaacaaauccugcuuccucaaaaaccuacgaucuaccgacaacgccuccaucccgaaccaaauccaaaggcaagaaauggaagcuauucuugacaaacaagcgaaauucuaccccuucuugaacgaacacaaagacgaacuacuccaacuccucucguuccgcaucccguacuacguaggcccccuagucaacaagaaguacagccgcuucgcauggcuaguacggaaagagggacagguccaaaagaucaccccaaccaacuucgauggcguagucgauaaacacaaaacagccgagaaauuuauggaaaggcuaaucgggaaagaugucuaccucccaaacgaacgaguacucccaaaagccagccuccuuuaccaagaguacugcauauucaacgagcucacaaaagucgcauacaucgacucaacgggcaagaaaaacaacuucucuucagaggagaagcucaacauauucgagaaacucuucaagaccaaaagggaaguaaccaagacggacuugugcaaaugccucaacaaugucugcaagcucaaagaaaagguaaaggaaacugaaauuauaggcaucaaggcuaaauucaacgcgaaauacucaacguaccacgaucuaaagaagaucaacggcauggagcaacuuaucgccgaugaagagggcaagccgcucugcgaggacaucaucuccauccuaaccauauucgaagacaaggacauacgccucguccgccucaaagaacugcucugucaaaacaaagaccugauuaacaaauucucccuuuccgccgagaagcucgcuaaaguacuaagcaccaaacacuacaagggcuucggaaacgucuccgccaagcuaauuaacggcauucgagacaaaaacugcaaaacaauccucgauuauuugaucgaagacgacaaagaagcauacuacggccgaaacaaccccaaucgcaaucuaaugcagcuggucaacgacagcagauuagcguucaaaggacagauagaucgcgagcagaacacccaccuggaagaucugucacuggaugaguuccuugacgaucucuacguuagcccauccauccgacgaggcauccgcuuaaccauucgccuggucgacgaacucgucgaaauaaugggguaccuccccaaaaacaucgucaucgaaaugcccagagaagacggggaaaagggcaagauagcagacacccgcuacagcaaauuagagaaaaugcucaaaaaggacgcagcccuugaagaccucuaccgggugcucaaaacauacgagaaaaacaaaaaggcgcuugccaaugacgcacuuuaccuguauuuccugcaaaacggccgagacauguacacgggcaaagaaaucaaucucucagaacuccauaguuacgacaucgaccacaucauccccaaaucauuuaaauacgacgacagccuagacaacaaaguacuaaccgccaagaaaaugaacauggacaaacgaaccggagcccucgaucacaacauaaucgaaaaucaauguggauucuggcggguccugcugcaacaggacaaaauaagccuggaaaaguauacgaaccucaugaaaacggaguucaccgaagcggacaaagccggcuucaucaugcgacagcuagucgaaacgagacaaaucaccaaguucgucgcccgauaccucgacaacaaauuuaacgggcugaucucggaucccaacgacaaaguuaacaucuuacucccacgcgccagcuugugccaccaauucagggaaacauucggcuucuauaaagucagggaacugaacgacaugcaccaugcacacgacgcuuaccucaaugcgguaaucgccaacacacuaaacaaaaacgcauaccucagcgaucugcucaaauacggagccuacagcaaauacaaaaagaacggguucaacaacagcaacggcauaauggacuacuucgguaacacccaauucaacugccuguuugucgucgaaagaacccuagacaaaugcagagucaauaucguaaaacaccccgagacagccuccggcgaguucuauaaugaaacuauacaaaagaacaaagucaacggcggauccucuacacgcagccucaaaucauccgucaaggugcuccagaacaccgaacaguaugggggcuucacaaacguaaacaacgcauacuucauucucuuugacuacaaggcuaaauccaagcucaagagaaagcucaucggaguccccaucguagauaggcaaaaguucgaacaggacccagugacguaccucgaggcgaaagguuuugacgaaccgaaguuaguccagaaacuacucaaauacacgcuccuagaauaugaagacggcaaacgccgauaccucaccggcgucaccgggaaacgaugugaacuggugcgagccaaccagcuccuccucccacgcaacaugauggcacucuugcaccaccuccaagaauggcaaaagcacgacuucggaauaaaagaaaugacgaagguuaucaagaacaccaacaauauagaggccaaauuugacaaacuuuuugagcauaugaugaaguucaucgacaaguacagcgaaccacccaagaucguaagcucaaaaaucucagaagaauaucacaagcuaagagagucccuaugccaagaugacaacaaaauaaagaucuacgccgaaaucggcaaagcccuuuuaucgcugcugcaccuaguugacagcaagucugccugcgucuucaaguucucugggcucgaaauaaaccgcauccgguaccagucaaucaacgaaaagaaggaaccagucauaaucuuccaaagccuguccggacugcgcgagucacgauacaaauauaaucaauga

SEQ ID NO: 6775 - RNA, 4209 nt, Artificial Sequence
  Cas9 variant
augaaacuacgcaacgcaaaggauuacagcaucggacucgacguaggcacgggcagcacggguugggccgucaccacucucgacggcgaucuauucacauucaaucaccgcccuacacuaggcuccagacuuuucgagagugcaucaacugcccaagaaacacgcgaagcacgcggugcacgaagacggcucaaacgacgucguuggcgcaucucccuauuacaagagcaauucgcugcggagauggagaguugcgacagcaacuucuucauccgacuaaaccaaucacgccuauggcaagaagaccguaccgaacaaggaaaaggauaccuauuuggcggcaaaccaauucucugcggagcucaaauuuucgcaaaugagcaagaauauuaccaacaauuccccacaaucuuccaccuccguaaguuccucgucgagugcucagaacaagucgaucuacgccuaauauaccuugcucuccacaacaucgucaaguacagggggaacuucuuauaccaagacaacaaaacccuuaacguacgaaacuucaacuuagacucccaaauagcggacuuccucgaccagcugcaacucuggugcgaaaacaacgaccucugcuuccacgagaucgauggcacgacgacacucgcaagccaacuaaauaccugcuuccaccagcaaucaaaccaacagaaaaaggacacacugaaaaccuuuuucgcaaccuguaucgaaaacgacaagauagccggcgagcucaccaaagcacugcugggcuacaaaaccgacuucaagauaaucuucaacaucgaaggugaaaaggacgaguacaaagccaaaugcaacgaagaagagaaaauccuuaaauuacaagaaaccauagaugaugcuaaccaagugcuccuccaauccauccucaacuuauacucuggcauuauagucgagaaaauccucaacaacaccgccgucaaaaaugaaagcgcacaaugcacccucucggccuaucacugcuacuccuacgcacucuacuccaaacaacugcggacgcuaaagaagcuagucagaaaauacaacccacaacgauauaaugaaugcuucaaccuuagcgccgaggaccccaaagccaagaaacagcucuguacguacgccagguacaacgcgcaacacucgaccgauuacgacgaguucaagaaauauauaaaagaccuauuugagaacaccgaugccgucaacgaugcagcguaccaacagaugaagcaagauuucgacgaagaaaaauuccuccgacgacagaaaaccuccgacaacggaguauaccccuaccaauuccaccucgaggaaaugcaacucauaauagaaaaccaagcccagcacuacccuuuccuaaccaaaaucaagccgaaauuagaaucgcuggucaccuuccgcaucccauacuacgucgggccacuuacgcaaaaaggaauacaacgcaacggccggaaguucgccuggucaaagcguaacaaagacgccgaaaaccaacgcaucuaccccuggaacugggacuccaucauagacaagucagccucagcagaagccuucauccuccgaaugaccggcaagugcaccuaccuuuacggggaagacguacugccaaaggaaagucuacuauaccaagaguucuguguccuaaacgaacuaaacggcgcccgauggaacugugacggcgaaagaagaaugccccucucaaacaaggacugcaaggccaucuaccgccaguuauuccucaagaaacaaaaagugagcuacgcagaugucucaaacuaccugaaagcacaagggcauauaaacaacagcguugcaggaggccaaggcgaacacggcuucgagagcacucuuucuucgcaucacuuuuuccggaaacucuucaacgucgacgccgccaacgaccuuacagcgcagcagaucgagaccgccgaacaauuaauccuauggggcaccaucuucgaagacaaagagauauucgagcagaaaaucaaagaacgauucggggacauguucuccaaagaugaaauaaaaaccaucgcgcgcaggaaauucucuggauggggcaagugcuccaagcaacuccucucgggccuaacagucgaaaccccaagaggacgggaauccauaaucgacgugcuaaggaacggacaccccgaaaacggacguaccuuggucuucaugcaagucauuacagacaaaaagcucgaguucgacaaaaagauagaagaauauaacaaugaacaccucgccaagacaaacgaguccguucuggacacggccauaaugucccccgcgaucaaacguggagucaaccaagcccuccacaucgugggagaaauccggcgcaucacaaaacaugacccuaccugcaucuacauagaaacaacccgcgacgaaaaggacggaaaacacaacacccgaacaagcucgcgcuacucaagccucaagaaaaaccucgaaacccugaaaagcaucgauaaagcaaacgcccccgcaauaaagcacucacucgagcuccuggaaacauacaaaaagcaaaacauugacgacaaacucuuccuuuacuuuacucaaaacggaaaaugcauguauucagggaaaucacucgacauuaacaacuuguccagcuaccaaauagaccacgugauuccccaaucauacauaaccgauaauucauucgacaacagaguacucguguacgcaucagaaaaccaaagaaaaucugacucacuacuacucuccagcguaauccaggccaaacaagaaccauuuuggacgucgcucgaaaaggcgggacuuaucagcgagaagaagcacaacaaccucaaaagaaagucucuguccgacgcgcaaaucaaaggguucaucaaucgacagcuggucgagacaucccagauagucaaaguccucagagacgaacucucccgaaucuugcccgacacaaagaucaucccaguuaaagccucccuaagccacgacguccgcaucgccugcaaucucuacaaaagccgcacagccaacuccuuccaccacgcacacgacgcccuacuagcguccaccaugggaagauuuguucagacacgguuccccgacauguacgaaaaccccgugagguauguaaaaauccucagggcuuacauugcgcaauccaaacuucagcacucagcccagacacgcaacuuugacucacggagcuuuauggcccacucauucuucugcgauuacuccaacgagaacggcgauacuaucuggaacagcgccucagaaaucgaacgucuccgacgcgcucugucauacaaaaaccuauaccucacccgcagaccguucaucgacgccggccaguucugggaccaaaccauauacagcccccaugacaaaaagaaaacgcccgacucucucaucccgcucaagaaaaaucucgacacccaaaaauacggcggguacucaggaaaagacuacgcacacuucuucaucuacuccguacucaacaaacaaggugacgucgaguacagauuugauggcgucccguuauacaucgcggccaacauuaaccgugaugauagaggggcgcuugcucaguacgccaagcagcuagucgagcacgaaaacgugccaaacgccaaaaggaagacaaaagaucuagucuuccaacgcauagaaagagccugcguccccaaauaucaauugauuugcaucucucaaugcagcggagacuccgacaggucaguaucugacuacuacuacauuacuggcaagaaagagguuagaaaugcccuccaacucgccuuccccaugcaccuauauggugcuauaaacgcaaucgaggacaagaaagagcucgacgacagcgcucucgaggagcuagucgucuacauacucagaaaugccccuagaaucgccccagacgucuuccggagacucaaccugacggaaaaauuagcggacuguuuagacaucccagacagaaucgaacuccaaaacagcaucuacggccuuuucaacuuaaucaaugcagaaagcaacguugucaaccuucagauuuucggaggggccaaaacugcgggugucaaacuaaucaacuuaaauucgcuccuaaacgaccccgccaccacgguaaccuucaucgaccaaucugucaccgggauguucgaacgaaaagaaacuaucggcauaucguga

SEQ ID NO: 6776 - RNA, 4209 nt, Artificial Sequence
  Cas9 variant
augggaaagcaggaauuuaacgacuacuaccuaggcuuugacaucggaacaaacuccgugggaugggccgugaccgaucaacaguacaaacugcuccgcuucaacaagaaagacauguggggaagccggcuauucgaagaggcuaaaaccgccaaagagcgccgggucuaccggaacucgcgccgccgucuugacaggcguaagagaaggcuaaagcuccuagaggaacuauuccuagacgaaauucucaagguggauucaaccuuuuucaagcgacucgaggaauccaaccucuacaacgaggacaagagcauaaaauuuaacuacccccucuucaaugacaaagacuauacagacauugacuucuacaaagaguacaagaccauauaccaucugcggaaagcacucgucuucgaggaccggaaauucgacauuaggcucuuguucauagcacuccaccacauacucaaauaccgcgggcacuucaucuucgaaggucagagcuucgaggacauaaagagcuucgauuacauauucaccgagauacaggacuggauuuuggagaacuucgaaaucaacauagacaucaaccugaaggaaaaacucgaggaaaucauucucucaaacaacaccaaaucaaucaagaaaaucgaauuuaagaaaaucuucucagacaaccgaauccuggccauacuuaacaugggagugggaugcaaagucgaccuuaaagaugucuuuaauaacgaggagcucaaggaccagaaaauaucauucaccgaaauagacuacgaaaacgaaaagcgagacgaguucuaccaacuacugggcgaagggauauuuauugucgaccuagcgaaaaagauauacgacuucaugguccugaagaaaauacugaaaaacucggacuacuucagugaguccaaaguagccuuauaugaagaacacaaagaagaccugaacagacucaaauacaucuucaagaaauaccuaaaaucauccgacuacuacaaauuuuuccggagcaacagugagaaaacaaauuauccuuccuacaucggacucaauaaaaucaaaaccaagcgacuuaucgaaaacaacaaaugcagcauaagcgacaucaacaaagaacuuaaaaacaaauaccuaaaagauauacaaguggaggcagaggacgaagaacucuuuaaccgcauccuucacaaaauuaaugagaacaaguuccuggaaaaacuaaagagcucagaaaacagcacaguaccauaccaaguccacgaaauagaacucaaaaagauucucgacaaccagcggaaguaccauuccuuccucaacgaaaaauccgauggaaugacccucugcgaaaagauaaucaaguuguucgaguuccgcauccccuacuauguggggccacucaacaccaaccccaacaugaacaagaaaaacaaaaauacaugggucguuaagaaagaggaaaauuccaaauccuccaucaccccuuggaacuucgaaaagaaagucgacgaacagaaaagcgcggaagaguucauaaaaagaaugacuaacaggugcacauaccuacgcggagaggacguaauuccgaagaacucacuccuguacgaagaguucgugcuacucaacgaauuaaacaagguaaccguggacaacgagcuccuacaucccacgcugaaaaaugaaaucauagacgagcuauucaaaaccaccguaaagguaacgaagaagaaaauuaccgaguuccuaaagaagaaacaagccaucagugacguagaaucaaucacgggcaucgacgucgaguucaacgggaaacuacaaggguacaacaccuuuagaaaaauccuuggcgagaaaauagaaaaccucaauaucaaaaaguucguggaacgcugcauugaacuaaaaugccuauacggcagcgacaagaagcuauucaaaaacgccguggggaaacucuacaaggaauacaacgucacggacgaagaguucacgaagaucaacaagcucaacuucaauaagugggggcggcuaaguaaggaauuuuugacaggcaucagauucgagaaaacugacggaaccgaacgauucgaauccgucaucgccgcccuccgguccacuaacuacaaccucauggaacuucuaucagacaaauuuaaccuacaaucaaagauugacgaaaucaacggcgaagacgauuucuccaacauagauaucaaggaauacgucaaugaacucuaugucuccccuucuguuaagcgcucgaucauacaaacguacaagaucgcgauggaaauaaagaagaucacagggaagaaccccaagaaagucuuuauugaaauggccaaagggggcggagaaaaagggaaacgaaccgagcgaaggaaggauaagauuaaggagcuauauaaaaauaugaaggacagccucagugacuacugcaacaaccuccaagaccuaaguagccaaguggagaaauacgacgacaauaggcugcggcagaaaaagcuauuccucuauuucaugcaaauggggaaaucaauguacaccggcaacgacaucgaccugagcgagcuguucaacaacaacaucuacgauauagaccacauauauccccaauccaaagugaaagacgacuccuucgacaacauuguccucguagaaaagcaagaaaaccacuccaagagcaaugaacuccuaaaacccgagauccaauccaaaaugaacaacuacuggaucuuccuccgcgaaaacaaguucaucuccaaggagaaguacaacaggcugacacgaaagaaaaacuucaccgacgaggaacuuggggacuuugucgcccgccaauuggucacaacccggcaaagcacaaaagaagucgcaaaacucuucgagaaaaucuucgacggcaccgaggucguauacagcaaggccucacucgucucggacuuccgagagcgcuuugacaucauaaaaguccgagaagucaacgaugcucaccacgcccaggacgcuuaucuaaacauaguagugggcaacguauucaacaccaaguucacaaagaauuacuggaaguucauaaaagagaacaaucggaaaaacgaggaaaaccccaacaagaaagagggguacaacuucaaaaacaucuacgaaucagacgucuuccggaaugaagacguagcaugggucuucuccaaagaaaacaaagaaaucaacacgauaaagacagugaacaaaauggucuaccguaaaacugugaacaucacagaaaugcuuguggagggaaaagggcagcuauucaaccugacaaucaaagaccggacccaacuaaagaaaaaggugggaaauaucguagccaacauaccaaaaucacucaagaaccgcaacaccaaacucaagagugaugaauuggcaaagaaauauggauacuucgacagccuaaacaacucuuauuucguucuguuuaaauacgucgaaaaagagaaagagaaaauaggcuucgacggaauaaccauugucgacaaagaaaaacucaaaaagaacagcgacaucgagcgcuuucuagagaacaaagguaacaaaaacgcaaagcuaauccgaaaaauauuuaaaaaccagaagguacucauugacggguacccguaccuguuaaaaagcugcaacaaggauaaagcgauccgcuucgacaacuucaaaagccuguacuuagaugaaaacgaccucaaguucacgcgcgacgcgauaaaguucgagaaaaacaacgcggacauugaucucaagaaacaaaaauacauaauuuccuucuuaaagaagaagaaacagaacgaaauuaacgaaaccuaugaagagugcauagaacggcucaauaacgaguucgacacacuuuuccuaaaccucugcgacauacaaaaaucacccaucuacaaaaacuacaaacuaccagauuucaucucgaagaaaaauguuguggaagucaaagacaaguucgaggucuucaaaaaccuggagcuauacaacaagagcaaauuaaucaagaacuuccucaacuacuucaaguacgauaacaauaagcucgaccucaucgcgaucggaaucgacagcaaagcaaacugcauccagaaacacuucacagaagaccucauaaaagacuuuguaaucguagacgaaaguguuacgggacuauucgcgaaaaaggaacgucuagaguga

SEQ ID NO: 6777 - RNA, 4209 nt, Artificial Sequence
  Cas9 variant
augacauacagaaacuaccacaucggccucgauauuggcaccagcuccguuggauucgccguccgauacgauaacggagagcugguccacaagaaaggcucaaaccuaguuggcgcccgccucuucaaagagggggaaacggccgaggaaaggcgcuugaaccgaggagcacgccgccguuacaacagacgaaaauggcgccucaaucuccucaaccaaauauuuaaaccucugaucgaagugaacgacccaaccuucuucaaacggcuggaacaaagcaaccucguaaacuaugauaaauccgaaucguucucccuacucaacaaucagucagacgacaaacugcaccagcaauucccaacgauauaccaccuuagagacuaucugaugaaaucaaccgaaaaagccgacaucagacuaaucuaccucgccguccaccacaucgugaaauaccgcggcaacuuccuugacgccucacccgucgacaguuucgaggcuuccaaccucaaaguggaugaaauucuaacccaaauaaaccuccuccucgacaaccuuaccgacgaucugcgccucaacacccaguacguaaccgacaucgaacagacacuacuaucaaacacagagaguaauaaggacaaagagaaaguaauacaaaaacuccugcuccacaaggaagccaucaaaauagauaaggaccguacagcccagauagccaaauuaguccucggauacaaggcagacaucgcaaaacucuucggaaucaccgaaaaacugcagacgccgaaacucgaacugucugcagcaaacagcgacgacgcccucauggaguugucggccgaacuaaacgaagaccaaauaggaauccuccugcagcuaaaaacccuguacucacgcguacgacucaaccagaucauucccuccggcacaucccucagcaagucgaugaucgaaaaguacgagcuacaccacacacaacucaagagcuucaaggagaauauacuacugaaacuucgccgaaacaccgcgguccgccggaaccuggaacucgcauacgcccucuacguaggaaaugcucaaaccaagcaagaagucuucgaacccaaaaaggcccgauucacguccgacgacuucgccagccucaaagcaaacgcaaaaagcgcguccucaguuaaagaagcccccaaaaauaccaagaccaaacuaaccaccgacgacuucuacaauauccuaaccgagcuauucgccacauuugaauccgaauuaagugcagacgaagauaugauaaaagaggucgaacaaaucaaaaaggcaauaacuggugacaacuaccucccaaaacagaggacagaccaaaacgggaacaucccccaccaacuccaccagauagaacuccgccaaauacuacaaaaccagcuuccacacuacccggaaauggacaaaaucaacgaacaaaaaccgaucgaaaaacuggucaccuuccgaguacccuacuacauaggacccuuaauuacccccgaagaccaacagaaaucaagcgcagcuaauuucgcguggaugaagcgaaaagaacagggugccaucacccccuggaacuucgacgacaaaguagaccgcaugcagucagcaaccaacuucauuaaaagaaugacagucaaagacaccuaccucaucaacgaggauguccuacccgaucgaucgcuccuguaccaacgauucaaaguccucaacgaacuuaaccuaguaaaagucaacaaccaacuacucagcaucggggagaagcaggcaauauaucacgaccuuuucgaaaagcaaaagaccguguccacgaagaaacuccaauccuaccuacagagcgagcagggcuacggagacaacaucgagauauccggacucucgaacccugacaaauucaacaacggccuuacaaccuacauagacuucaagaacaucuuuggugaccuaguggaggacaccaccaaacaaaaggaguucgaacaaaucaucgaaugguccacggucuucgaagaccgcgcaaucuucaaagccaaacugcaggaagucaacuggcuaaccgaggaacagaucaaagcgcucguagcaaaacgcuacuccggauggggacggcugucguaucgccugcucgcggaacucguuaaugacaacggcgaacgaaucaucgacaucuuauggaacaacaaaggcagcaaccucauguccauagugucccaggacgaguuccaacaacagauagcccgaaucaacucccacgagguccaggagcuagguauggaaucggucuuagcgaacgcauacaccagcccccaaaauaagaaagccauccgccagguaaugaaaguagucgacgacauccaacucgccaugaacgggcaagccccgaccucuaucucgauugaguucacgcgaaagcccgaagaaaauuccgaaaucagcaaaagcagauacgaaaccaucaccucaaucuaccagagccuuaguaaggacauugaaaaggaaguuaaagauaaccugaacaagaacaaaucaagccucaagaaaaacuuauccgacaaauacuaccucuacuucacgcagcuaggccgcgacaucuacaccaaccaacccauccccuucaacgaaauaccuuacuaugacaucgaccacaucguaccccgcucuguggaaaugaacgauucccucaacaaccgcguccuaguagcgaaguccauaaaccaaaucaagaaaaacaacgcacccauagauuccucacuaaaaaucaccagugaaacccggcagcucuggaagaaacuccucgacuccggccucaucacgaaacagaaguauuacaaacucaguagcucgauuaaaaauacggucucccccuaugugaagcaaggcuucauaaaucgccagcuagucgaaacaucucagguuaucaaacucgucgccaacauccuuggaacaaaauaccaaaacgacgacacagagauuauagaggucaaggcacaccucaauagcgaaauucgaaagaccuuugaauuuuauaaacuccgagaacuuaacgacuaucaccacggauucgacgccuaccuaacaacccucguaggcggcuaccucuacaacagauauccaaaacucagaucguacuucgucuauggagaccacaaacgacucgacaaggcacaacucucagaacucaaaaacuucaauuuccugcacggccucaccaacccaaaaucgggcuccgacggauuaaucaccgccagcggcagccagcaggucgugcuagacagaaacgaaaccaucaaacgccuaaacaagauauacagauacaaguacaugcuuaucucaagagaagucuuuaccaaacaaggccaguucuacaacgaaaccaucuacccagccaaaccaaacaccgcgaagaugauuccacucaaagacaacaagccaagcgaggucuacggcggcuauucgagcucgaacgucagcaaaauagcgcucaucaaggagaaaaacaccgacaacuaccaauucauagggauccccauuagaagcaucgccaaacugaaacaagcaaaagcuaauucaaagacgguguaucagacugaacuuaaucgcguaauaaaaagcguucucgcgucccagaaaacuaagaaacaaaaagaauuugaaguaauccuagacaacguaaaauauaaucaagucgucgucgaucaaggcgaaaaauauuaccucggaucccccuacuacaagaaaaaugcgaaacaacucgucaucuccccugaaucggucaaaauacuagcggacaaagccacagcagaccuaccugaacaagaggcccacaauaaacucaugacaguauaucaggaaaucguggacguacuaaacaaacacuuugcauuauacgacaucaauaauguaaggaagaaacucaacgacggucucaucaaauucagccaacucccgaacuacgacgagaccagcaaaaaccgcuuugacaucaguaaguccaucaagacgaaguaugcggucaucaugagaaucuugucaggaaucaaaaaccaaacaagcgaaguacccgagcuggggcuaaaauccccacucaacaagaugcaaaccaaaggcgguauaaaaaucagcccugaagcgaagauauacuacucaagccccaccgguauauucucacacuucaagcaggucaagaaccucuga

SEQ ID NO: 6778 - RNA, 4209 nt, Artificial Sequence
  Cas9 variant
auggaacgaauacucggacuagaccucggaguaagcaguaucgguugggcguuagucgaagaggacgugaaaaacccagagaacaacaaaaucaucaaacuuggcguacgaguaaacccgcuaaccauagacgaaaagacaaacuuugaaaaaggaaaaagcaucacaacaaacgcaggccgaaccagugcgcgcagcgcgcgccgcaaccuccaacgcuuuaaacuccgccggaaaaagcugcuugaaaucuuaauucacuauaagaucaucaaaaacgacgccguucuggccgaaacaggaaagaauacgacauuccagacccaauaucuucgagcaaaagcagccagagagaaaaucgaacuagaugaacucgcgagggugcuacuacucaucaacaagaaacgcggguacaaaucgucuagaaagguacagaacgacgacgacgggaaggccaucgacggucucucgguggccaaagaguuauacgagaaaaacuacaccccgggacaguacgcguacgaccuccuaaaacgaggcaagaaacaaaucccagacuucuaccgcuccgaccugcaaaacgaacucgacaggauaugggaguuccaaaaacaguaccacccagauaucuuaaccgaugaguucaaaaaggaacuagaagggaaaggacagcgagccacagcagccaucuucuugaaccgcuacaagaucuacacagcagacaacaaggggaccagggaagagaaaaagauucaggccuaccaguggaggguugaggcgcuuagccagccccucgauguaaaggagguagcguacgucaucgccgaaaucaauaacaaccugaauaacaguagcggcuaucuaggggcaaucucagaccguucgaagaagcucuacuucaacggccagaccauaggcgaauacuuguucgaggaauugagcgccaacccccacacucgccugaagaaccagguguucuacagacaagauuaccaagacgaguucgagaaaaucuggaaaauccaaaccaaauuccaucccgaacucacgaaagaacucaaggagcaagugcgggacaucgugaucuucuaccagcgcaaacuaaagucccaaaagggacugaucagcuucugcgaguucgaaagcagagagaucgaaaucgaagaaaacggaaagcggaaacggaaaaagguaggccuuaagguggcaccgaaaaguucgccccucuuccaggaguucaaaauauggcagguccuaaacaacauagaaaucaaaaacgaggacgaaagaagauaccuggaaccagaggaaaaggaacuacuuuucaacgaacugaacugcaagggcaaccuaaccucgcagaaaugccucgagcuccuaggauucaagagcaaagacgccaaacuaaauuucaaaguaguugaaggcaacagaaccaacgaaaaacuuuacgacgccuuucucaaaauacuggagcuucaaggguacaacgucuucgagcuccuaaaaauaaaagaagauaaagacgaagcuaaacucagcgaacucaaagcaucggcggaugaaaucaaagggaugaucaaggagauauucaaugccaaccugaucaacacaucgauacucgacuucaaugccgaacuggagggaaaagacuucgagaaccaagccucauaccaauucuggcaccucauguacagcuacgagggagauaauucccccuccgguaacgagaaacuuuaugagcuacuagaaaagaaauucggcuucaagaaggagcauuccaaaauccucagcacaaucgucuucagucaagaauauggaagccucagcacgaaagccaugcgccgcauauaccccuacaucaaagacaacaaguauagcgaggcaugccuacuugcaggcuacaaccacagcaaacacucccuuaccaaagaggaacucgagaaccgcaaacuaaaagaacagcucgaaguacucccuaaaaauucccuccgcaacccaguaguggagaaaauccucaaccaaaugaucaaccuuguaaacgcaaccauaucggaauacggcaagcucgacggaguaagaaucgaacucgcgagagaguuaaagaaguccgcgcaagaacgcgaagacauggccaaguccaucaaugaagcuacauugcugcaccaaaaguacgccacaauacucaaacaggaguucggcgucguaaacccaucgcggaaugacaucauucgguacaagcuguacauggaacucacagucaauggguacaaagaccuauacacgaacacaaagaucgaaaaagaaaaccucuucacugacaaauacgacaucgaccacaucauuccgcagagccgcuucuuugacgacagcuucagcaacaagguccucgucccacgacaguccaaccucgacaagggaaacuugacggcauacgacuucaugucaaacaaggggucagaaagagaggaacauuucuuaaacguaauuaaagagcuacuagacaagggaucgauauccaaggccaaguacgaaaaacugaaaaagaaaggccucgaaaucggcgacggcuucaucgaacgagaucuccgcgacacacaauacaucgccaagaaagcgaaagagauccucuuugaaauaaccaacucgguaguaaccaccagcgggagaaucacagauaagcuccgaaaagacugggaccuaguaaauauaaugaaggaacucaaccuugacaacuaccgaaggcuaggccuaaccgagauagugcgaaauuccaaaggcgaagaaaaggagcucauacccgacuggacgaagagaaacgaccacaggcaccacgcaauggacgcgcucacuguagccuucacgacccgcaaccacauccaguaccuaaacuaccugaacgcuaggaaggacgaaaaacacaaagaacaccagaacaucuacgccaucgaaaauauaaucacggaggucauagaaaagaaaaacggcucuaagacccgacgauucaaggcgccgaugaacucuuucagacacgaagcgaaacaacaccugaaggaaauacuggugagccacaagaccaaaaacaagguagucacuagcaacauaaauaagaccaaaaagaaaggagggauacacaagaaaacagaacugacgccacgcggacagcugcacaaagagacgguauacggcucuaagaaauuccuacagucacgugaagagaaaguaucggcaaaauucgacuacgaaacaauacucaugguaguaaaccccauccaucggaacgcccucuuaaaccggcucaaagaauaugggaacgacccuaagaaagccuucucgggcaaaaacgccauaaacaaaaacccagucuaccucgacgacucgaagacagauauacuauccgaaaaagugacccuaucgugguaugaaacaggcuacaccauacggaaauccgucaccccagacaacuuuaaggacuauaaaaaccuagagaaaauaaccgaccucggaauuaagaagauccucaaagaacgccuagaccaauucaaaggaaacgcgaaagaggccuucuccaauuuggacaaagacccaaucuggcuaaacgaggaaaaagggaucgcaauaaaaaccguaacuaucaccggcgugagcaacgccgagagccugcacuucaagaaagaucaccuaggcaaagagauccucgacgaaaauggaaacaaaauaccaggagacuucguaagcacgggcaacaaccaccaccuugcaauauaccuagacgaagaagaaaaacuggacgacaaaauggucacauucuacgaggcggugcuuagagucaaccaaggccuccccguaauagacaaagacuacaacaaagagaaaggguauaaauuccuaaugacacuaaaacagaacgaaauguucguauucccaaacgaggauuucgaucccaacgaaaucgaccuucuagacgagcguaaccuggagcgaaucucaaaacaccuauucagaguacaaaagaucuccaaggugggcuacggcaacuccuucguacgcgacuucguauuccgccaccaccucgaaacgacggucgaagaacgcaaagaacugcggaacaucacuuacauacaacugaaaagccuagagggucuaagaaacaucaucaagguuaggcucaaccacuuaggaaaaauaguacaaauaggggaauacuga

SEQ ID NO: 6779 - RNA, 4215 nt, Artificial Sequence
  Cas9 variant
augacaaagaacauacugggccuagaccuaggcgucagcagcaucgggugggcgcugguacaagaagacucaaagaacccggaaaacaaccgcauugucaaacugggcgugagagucaacccccucaccguagacgagcaaauaaacuucgaaaaaggaaagccaauaaccaccaacgcgagcaggacccuagcacgaucagcgcgacggaaccuccagcgauucaaauucagacgcgcgaaccuaaucgaugugcuaaaaaagugcaauauacugaagcagggcgaccuacuaaccgagaucggcaaaaauagcacauuccaaacccaagagcugcgagcaaaaucugcaaaagaaaagguggagcucagugacuucguccgggugcuacuccucaugaacaagaaacguggcuacagaagcagccgcaaagccaaaaacgaagaugagggacaaauaauagacggaaugucagucgcgaaaaaacuguacgaagagaaccucacaccaggcgaguacuccuaccagcuccucaucgagaacaaaaaacagcugccagacuucuaccgguccgaucuccagucagaauucgaccgcgucuggaaguuucaaaaacaauuuaaccccgagauuuuaaccgacgaccucuacaaagagcugcaaggcaaaaauaagaacgcuaccugggcgguacuuaaggaaccauucagcuuaguggggaucaaacaaauaggcaccauacaagaaaaaaaagcggaaaaauacuucuggcgcucagaggccgugaagcgucaacucgacuucgaaagucuggccguagucuuccaggaaaucaacagcaaccucaacaauucuucuggcuaccucggcgccauaucagaccgcucgaaagagcuguacuucaacaaucagaccgucggcgaauacuuauuccaacagcucaaggagaacucccacaccaaauugaaaaaccaagucuucuaucgacaagacuaccuagacgaauucgagaagauaugggagacccaaagcaaauacuacaaagagcucacuaaggaauuaaaggaggaaauccgagacaucauaaucuucuaccagagaaaacuaaaaucccagaaaggauuaaucucaauaugcgaguucgaaaaccgggaaauugagaucaccgagaacggaaaaaucaaaaaaaaaaccguaggccucaaaguagccccaaaguccucaccacucuuccaagaauucaagauauggcaaguacuaaacaaccuaguguuccagagcaucgaauccaaggagcuauucccacucgaccuagacaucaaagaaucgauauucaaugaaguaaacauaaaggggaacuuauccgcaaaaaacguucuggaccuuauggguuacagcgggaaggaguggaagacuaacuucaaaaacaucgagggaaaccgcacuaacgaaaaccuauacaccgccuuccucaaaauaaucgccagugaggggaucgaauucccgaaggaauucaaacugucaaucgacgacgacaucaaggucuccaaaaucgacaucagcucggaaaaaauaaaggaguuuauaaaagaaaacuuccuaaaacuuggaaucaauacaagcauacucgacuuuaaccccgaacuagacggaaaagacuuugagaagcaagaauccuaucagcuguggcaccuacuguauuccuacgaaggcgacgacuccgccucuggcaacgucaaguuauacgaacuacuggagaaaaaauucggguucaagaaggaacacagcaaaauccucgcagacgugggcuucuccccugacuacggcagccuaagcuccaaagcuaugcgcaaaaucuacccauacaucaaagagaacaaguacucagacgccugccaccuagcuggcuacaaccacagcaaaaacagcuucacaaaggaccaacucgcuaacaggauacucaaggaacaacuagaaauacuacccaaaaaugcccugcgaaaccccgucguagaaaagauacuuaaccagaugaucaaccuagucaacgaaguaaucaaagcguacgggaagccggacgaaaucagaaucgaauuggccagggagcucaaaaaaaacgcggaggaacgggcuaacaugaccucggacauaucaaaagcaacacuacuucaccaaaaguacgccgagguauuacaaaaagaauucggaaucaaagccccgucccggaacgacaucauccguuacaagcuauaccucgaacucgagaaaaaccuauucaaggacuuauacacagacguacagaucaagcgagaagagcucuucacagacaaauacgacaucgaccauauaauaccucaaagcagauucuucgacgacuccuucagcaacaagguacuaguuccgcgaggcgcaaaucuaaaaaaagggaacuucacggcacuagauuacauggagaucgagggcaaagagaaguuggaaaaguucuuaaacauaauaaaagaacucuucgauaagggcgcaaucagcaaagcgaaauucgagaaacuccagaaaaagggauccgaaauaggcgagggcuucaucgaacgcgaucuccgugacacccaauacauagcgaaaaaggcgaaagagauacuuuucgguauaacaaacucggucaucuccaccucggguaggaucaccgacaaacuacgcgaggacuggaaccuaguaaacaccaugaaggagcuaaaccucgagaaguaccgcaagcucgggcucacggagcuaaucgucaauucaaaaggcgaagagaaagaacgaauaauagacuggacgaaacgcaacgaccacagacaccacgccauggacgcccucaccguggccuucaccacgcacaaccacauccaauaccucaacuaccugaacgccagaaaggacgaaaaacacaaggagcaccaaaauaucuucgccauagagaacacaauaacggagaucgucgaaaagaaaaauggauccaaagagaggagauuuaaacucccaauaaagaacuuccgcacagaagcaaagaaacagcuagaggagguccuaaucucccacaaggcgaagaacaaagucgugacaaaaaacauaaacaaaaucaagaaaaaagggagcaucauagcuaagacggaacucacgccccgcggccagcugcacaaggaaacgauauacgguagcucaaaauuccucaaaacuaaggaagaaaagaucagcggcaaauuugaucucgagaugauacagaaaguccaaaacgagaaauaccgcaaugcccuucucaaacgccugcaggaauucggaggcgacucuaagaaagcauucacaggcaaaaacgucaucagcaaaaacccgauauuucucaacgcagagaaaacggagcaacucccggaaacagucacacuggcgugguaugagacaggcuacaccauacgaaaagucguaaaccccgacaacuucaaagauuuuaaaaauaucgaaaaggucaucgacaaggguguaagggacauucugaccgaacggcucaaagaauucaacggcaacucaaaggaagccuucucgaaccuagaaaaaaacccaauauggcugaacaaaucaaaaggcaucaguaucaaaaccgucaccaucaccgggauaaauaaugcggaggcgcuccacuauaagaaggaccaccuaggaaaggagauccucgacgagaaugggcaaaggaucgcgguagacuucgucagcaccgggaacaaccaucacgucgccaucuacgaggacgacaauggcaaccuccaagagaagguaguauccuucuaugaagccguggagcggguaaaccagaaucuccccauuaucaacaaagaauacaacuucgaacucggauggaaauuccuauucacaaugaagcaaaaugagauguuccuguucccgucagaugacuuugacccgaaagagguggaccuguucgacgauaaguaccuaucacuaaucucgaagaaucuguucagaguccaauccauaagcaucguccaguacggcaacagcgugauccgggauuucaaauuccgacaccaccucgaaacgagcgugagugacgagaaaaaacuccagggggugaccuaccaacaaaucaagucacuacaacccuuaaaagacauaaucaagauacggcuuaacaaccuggggaagauaguacagauaggggaauacuga

SEQ ID NO: 6780 - RNA, 4215 nt, Artificial Sequence
  Cas9 variant
augaaaggaaacaucgagaaaaagaaacaggaguucaacgacuauuauuuaggcuuugauaucgggacgaacuccguaggaugggcagucuccgaccuguccuacaaccuccuacgcuuuaacaagaaagacauguggggagcccgacucuuugacgaagcgaaaacggcuaaagaccggcgcgucaaacggaacucgcgccgccgacuggaacgucggagcaaacgucucaaauaccucgaagaaauuuucgaaacggaaauaugcaaaauugacaaaaacuucuuccgccgacuagaagaaagcacgcugcacaacgaagacaaaacguuugacuuccgauuccccauauuuaaugacgaaaacuacacugauaaagaauacuacaaagacuucccaacugucuaccaccuacgcaacgaacucaucaaaaaugaaaacaagaaauuugacauccggcucauauaccuggccauucacaacauucucaaauaucgagggcacuucaucuucgaaggucaagacuucgacagcgucaccgacuucaaagaaguuuucucggaacuaucagcauaccugagcgaaaaccuagaagaaaaccuagacaucaaccuuugcgauaacaucaaagacaucaucugcaguaaagaaaacaaaacaucaaaaggaaagagcuucguuucgcuaauugacucaaaagucauacaaucaguccugagaugcugcauaggguaccgagucaaauucaaagacaucuucaucaacuacgaagaaaaagaaaagaacgaagggaucaaccuauccgaaauagaauacgaugaaaaacgcgacgaaauagcgcucagccucggagaaaacauccuccuaauagauauaugcaagaagguguacgacuucaugauccuuaauaacauucucaaaggaaauaaauauauaucugaaagcaaaguuaaucuuuacgacgaacacaaaugcgaccucugcaaccugaaguacauuuucaagaaauaccugccgaagaaagauuauuucgaguucuuccgcaacgaaaauaaggagaagaacuacguaucuuacauaagcucuagccucaacaacggcaagaagaaaaauaccuguacgcaagaggaccuaaacaaggaaaucaaggaauauauagccaaaaucaaagaauacgaggagaaugacgccguccuagaaaagauaaaccuaaaacuaaacgagaacaaacuacuccccaaauugaaaacaaaugacaacggaguaaucccauaucaaauacacaagauagaacuagagaaaauucuccagaaccaaagcaaauauuacgauuuccuccucgagaaaaucgacgggauaacaaacaucgaacgcauagaaaaacuuuucacauuccgcauccccuauuauauaggcacgcugaaaggcaaauucagcugggccaaacucaaagagaacaaaaagauaacccccuggaacuucgagaaaaucgucgacauggaggaaucggcgaaggcuuucauagaacggauguccaaccgcugcagcuaccucaaaacagaaaacguccugcccaaaaacucccuauuguacuccgaauacgagcuccugaaugaacugaacaaagucaaaauuaaaaaugaguuuauaaacguaguacucaaaaacgaaaucaucgacgaacucuucaagacgacguccaaagucacgaagaagaaguucgucgacuaccuuaagacaaaacaaaucuucguggagaaagaagauaucagcgggcucgacaacgaguucaaaucuaagcuagacucuuacaucaaauucaagaaagucauaggggacaagaucgacacacucagagguuacaacuucgucgaaaagugcaucgaguucaaguguuucuacggugacgacaagaaacucuucaagaacgcgauaaacaacacggaguucaaagacuacguuagcgacgacgagcucaagaagaucaacaagaugaaauucaacaaauggggacgccuaagcaaacgccuacuaacggaaauaugcuucgaaaacguaauagagucagagagcuucgagaacaucaucguggcccugagaagcaccaacuacaacuucauggaguucacauccaagaaauucaaucuauccgagaaggucgcggaagaaaaucaagaaaauacacuggaaaaguucaacauaaacgaguacguggacgaacucuacgugucgccauccguuaaacgauccauaauacaaacuuacaaaauagccauggagaucaagaaaauaacgggcaagaacccuaaaaagauauucauagaaauggcccgcggcggaggcgagaaaggcaagaaaaccgaaaaacgcaaagaacgaauaaaaacccuguacgcgaauaugaaagauagcaacgaggaguuccugaacaaucucgauaaccugaaauuguccguggacaacuaugacgacaaccgucuccgagagaagaaacuguuccucuauuucaugcaacucggaaaauccauguauaccgggaaaaauauagaucucaacgagcuccuauucgcaaauacguacgacauagaccacauaauaccucaguccaagcuaaaggacgacagcuucgacaacaucgucuuggucgagaaaacgauaaacaaagacaaggacaaccgagacuaccucgacgagucgauuagacuccgaaugaacaaauucuggaacuuccuucgagagaagggcuucauuaccauagaaaaauacaaccggcuccguaggaacaccuacuucuccgaugacgagcucagcggcuucaucucgcgacaacuggugaccacucgacagucaacccucgaagugaaaaagcuauuugaguucaucuuccagaauacagacgucgugugcuccaaagcaaacuugguauccgacuucagggagaaauacggcauuauaaaaguaagagaccucaacgacgcgcaccacgcgcaagacgcguaucuaaauaucgugguuggcaacguauucgauacuaaguucaccaagaauuacuggaaauucaucgaggaccggcggaagguugacaacauacgcgaaacguacaacuuuaagaaaauauucgacuacgaugucagccgcggcgaaaacguugcauggcucaaagacuacagcauaaacacaaucuccgaaaugaucaauaaaaagaccgccaacauuacccagaugaucacagaaggcaaaggacaacuuuucgaccucaccauuuuaaagaaaagcaaaauagacaagaagcugacggucauccccaacacaccgaaaauacucaagagcagucucaaagacagcugcaagauagccgagaaauacggcuacuucagcacccugaugccggccuacuucguaguauucaaguauaucgacaaaaacaaggaaguuuucggauucgacagaaucuucaucuucgaccgcgagaaaauuaacagcaacgaggauauagaaaaauacuuagaagauaaaggcuacaauuccccaaaauuuauucguaaagugaaccugaaacagaagauccucuuaaacggguacccauacagaauaguuggauucaccgacaacaagcuggagauuaagaacagcaaacaguucuacagcgacggggaacaccucaaguauauaaagcacuugagcgcauucuacaacaacaacaauaacgugaaaaacggcgaauaccgaauuaacuuucuaaagaaaacuucagagaacgaccgaaacgagacgacugaugaagcaaaggaacgccugaacaucgaguucauuaaacuuuacgaauacuucugcgagcgccucaacucuaaaaucuacgccaacuacuauaacagcaagaaauacgacgaacucauagaggucuucgacugcuucaagaaucuaaaccuacuggacaaagcuaagcucuugcuggaguuccuaaaaauauucaagaaagacacauauggcaauuucaaacugcucgagaagccagaacuagacaaaaacggcaaacaaaagcuagacaagaacggcaaccucagcuuugagggcuugaguauggccuucggcaaacugaacggaaagaaauucaaacagcuaguggagaaagacauccaauucguagacgaauccgugaccggcuuguucgagaagaaagaaggacucgaaaaauggcaggacggagagcaauga

SEQ ID NO: 6781 - RNA, 4215 nt, Artificial Sequence
  Cas9 variant
auggccaagaaaauacucggacucgaccuaggcgucucaucgaucgggugggcuaucguggaggaagacgccgagaacgucaugaacaacaaaaucgucaaacucgggguccgagucaacccccuaacagucgacgagcaaauaaacuucgaaaaaggaaaacccaucaccacaaacgccggccguacgcucguucgaggggcgagacgcaacuuacagcgcuucaaacugcggagacugcaucuuaucgacauccugcaaaaacgaaacauacuaaagcaagccgaccuacucgcggagagcggacgaaacagcaccuuccagacucaagagauccgggcaaaaucggcuaaacaaaaggucgaacucuccgagcuggcccgaguacuccuccugaucaacaaaaagcgcggcuacaaaucaucacgaaaagcgaagaacgaagacgagggccagauagucgauggcauguccguagccaagaaacuuuacgaagaaaacacaacuccaggagaauacucauaugaacugcucaaaaguggaaagaaacagcuuagcgacuucuaccgcucggaccuacaagccgaguucgaccgcguguggaacuuccaaaaacaauuuuaccccgaaaucuucucggacaaccuauacaaggaauugcaagguaaaaacaaaaaugcgaccuggaaaauccuggaaauaccguuuagccugguggguauaaagcaaguaggcaccacccaagaaaagaaaauagagaaauauuucuggagaucugaggcuguaaagaaacagcucgacuucgaaucccuggcagucguauuucaagaaauaaacagcaacuuaaauaacuccucaggauaccucggugcaaucagugaccgcuccaaagaacucuacuuuaacaaccaaacagucggggaguaccugcacugccaacuaaaagaaaauccccacacgaaacugaaaaaucaggucuucuacaggcaggauuaccucgaugaauuugagaaaauaugggaaauccagucgaaauaccacacuguacucaccaaagaacuaaaagaagaaaucagagacgucaucauauucuaccagcguaagcucaaaagccaaaaggggcucaucagcauaugcgaguuugaaaacagagagauugaaaucaccgagaacggcaaaaucaagaagaaagaagucgggcugaaaguagcaccaaaguccagccuccuuuuucaggaguucaaaauuuggcaaguccucaacaaccuucaauuccagaacauugaaagcaaggaaauauucccccucgaccuagacugcaaagagagcaucuucaacgaagucaacauaaaagggagaaucagcgccaaagcggugcuagacguccuagguuacucaggcaaggaauggaaaacaaauuucaaggacauagaaggaaacaacagcaacgagaaccucuacaacgcauaccuaaaaauuauagcaaacgaggggaucgaauuuccaaaggaguucaagugcaaccucgacgacgacaucaacgucuccaaaaucauaugcuccgccggaaaaaucaucgaauuuguccgcgaaaaauuuagugaauugggcaucaacaccagcauccucgacuucaacagcgaacuagaaggaacgaacuucgaaaaacaaaaguccuaccaacucuggcaccuccuguacucauaugacggcgacgauagccccagcgggaaccaaaaacuauacgagcuacucgaaaagaaguuuggauucaagaaagaacacuccaucauccuggcagacauagguuucccgcaagaauacggcucuuuaucaacaaaagccaugagaaaaaucaucccccaccucaaaacaggccuucccuuugcaaagaaaagcgacaacgauaccauacuauccgccaccgccauggcaggauacaaucacagcaaaagccugaccacagaagaacugacaaaaagaguccuaaaagaacaucucgaaauccuccccaaaaacagccuucgcaacccagucgucgagaaaauacucaaucaaaugaucaauguagucaacgaagugaucaaagaauacggaaagcccgacgaaauacgcauugaacuagcacgagaauugaagaaaaaugcugaggaaagagccaacaugaccagcgaaaucggaaaggcaaccauccagcaccaaaaguacagcgaaauacuccaaaaggaguucggcauaaaguccccgucccgcaacgacaucauccgcuacaaguuauaccuagaacugagcaacaacggcuuuaaggaccuauacacagauauacaaaucaaacgcgaagaguuguucaccgacaaauacgacauagaccacaucaucccgcaaucccgcuucuucgacgacuccuucucuaauaaaguucuggugccgaggggagccaaccuaaagaaaggaaaccucacagcguucgauuaccuagaaucugagggcaaagauacgcucgaaaaguucaucaacaccauuacggaguucuaugacaagggcauuaucaccaaggcgaaguaugaaaaacuacagaagaaaggcacggaaaucggcgacggcuucaucgagcgggaucuccgcgacacacaauacauagccaagaaagccaaagaaauccuuuucggcaucaccaacuccgucguaaguacaagcggaagaaucacagacaaacuccgcgaggauuggaacuuagucaacacgaugaaggagaugaaccucgaaaaguaucggaaacggggacugacugaaacagucauaaacaguaaaggugaagaaaaggagaaaaucauagacuggagcaaacgcaacgaccacaggcaccacgccauggacgcucucaccgucgccuucacgacccacaaccacauccaguaccugaacuaccucaacgcccgcaagaacgaagaccacaagcaacacaaaguaauuuccaacauugaaaaccugaucacaaaagucuuugaaaagaaaaacggaagcaagcaaaggcgcuuccuggaaccaauacacaauuuccgcaucgacgcuaagaaacaccuggaagagauacuaauuucacacaaagccaaaaacaaaguagugaccaaaaauauaaacaagauaaagaagaaaggaagcaucauagcaaaaaucgaacuaacaccccgaggacaacuccacaaggaaacaaucuacggauccaguaaauaccuaaaaaccaaagacgaaaaacuaucgggcaaguucgaccuugaaaccaucaacaagguacaaaacgagcgcuacaaaaacgcccuccucgagcgacugaaagucuucggguacgacagcaaaaaggcuuuuaccggcaagaacauccucgcaaagaacccuaucuucuugaacauagagaaaacggaacagcuuccagaaguccuaacccuagccugguacgaaaccauauacaccauacgcaagucgauaaacucggacaacuucaaagacuauaagaacauugacaaagucacagauaagaaagugcacaacauccucacagaccgacugcgcgaauuuaauggaaacucaaaagaagccuucucagaccuggagaaaaaccccaucuggcugaacaagccaaaaggcauugcaauaaaaaccgugacgaucaccggaguaaacaauguggaagcccuccacuacaaaaaggaccacuucggaaaggaauuucuagacgaaaaaggccauaaaauccccgucgauuucgugagcaccgguaacaaccaccauguagccaucuacgaggacacggccggcaacuuacaggaacgggucuuauccuucuacgaagcgguugaacgaguaaaccaaggucugucuguaaucgacaaagaauauaauucaucgcuaggauggaaguuccucuucacaaugaagcagaacgaaauguuccuuuuccacagcgaagacuucaacccgcaggagaucgaccuguacgacgagaaaaacuugcgccucaucagcaaaaaccucuucagaguccagaaauucaccgugaaggacuacuucuuccgccaccaucucgaaacgaacguugaagauaacuccaagcuaaaaggcgacaccuggaaacgcgaagggcuaaacggcauccgcggcauacuaaagguccgacuaaaccaccuaggcaaaauaguccaaguaggcgaguacuga

SEQ ID NO: 6782 - RNA, 4215 nt, Artificial Sequence
  Cas9 variant
augagcaagaaaauccugggucucgaucuagggaccacuagcaucgggugggcguucgugcgagaggcggaagacuuccaagaagaaagcagcaucgaacgaauaggaguacgcgucaacccccucacgacagacgagcaaaucaacuucgagaaaggcaaacccaucaguguaaacgcagaccguacccucaaacggggcgcucguagaaaccuccagagauauaaacaaaggaggaccaaucucauacagcuacucaagcaguacaagauaaucaaugaaaacacaauucucgcggaggacgacaaaaacacgacccacuccacauacgccuugagagccaaagcugucagcgagaaaauauccaaggaagcauucgcaagaguccuacucaugaucaacaagaaaaggggcuauaaaucaagccguaaggcaaagaaugaagacgagggacaagcaaucgacggaaugagcguagccaaacggcuguacgaagaggacauuacccccggacaauuaugccuucaacugcucaaagaaggaaagaagaagcuaccagacuucuaccuauccgacuuacaagcagaacuagaaaagaucuggaacuuccagaagaaauucuaccccgaaaucuugaccgacgaguucaagaaagagauugagggcaaaggucaacgugccacauccgccucauucugggccaaauauaaauuuaacaccgcagagaacaaaggcaguagggacgagaagaaaaugcaagccugggaauggaggucuaaagcaaucaacacccaauuaacccgugaggaaguagccuacgucauaacagaaaucaacaacaacaucaacaacucgaguggguacuuaggcgcaauaucggaccgcagcaaagaacuauacuucaacaaggaaacugugggggaguaccuauuucgccaacugcgcuacucaccccacacccgugugaaaaaccagguguucuaccggcaagauuaccuagacgaguucgaaaccauuugggaaaaccagucacgcuaccacaacgagcuaacgaaugagcucaaaagugagauccgagaugucgucaucuucuaccaaaggaagcucaaaucccaaaaaggacucaucucauucugcgaguucgaaagcaagcaaaucgaaauacagaaagacggcaaaaucgucaagaagaucaucggccucaaagucuccccaaaauccaguccccucuuccaagaguucaaaaucuggcagauacuccagaacuuggaguucaccaacaaggaaaccaaggagaaaaaggugccagauuuugaagccaagaaccuccucuucgaggaacucaauaucaaggggaaccuaaagggcgaaaaagcaaucgaaauacuaggcuacaaacccaaagaguggcugguaaacuacaaggagcucgacggcaaccgaaccaaccaaguccucuaugaaggcuaccucaaaauucuagagguggagggcuaugacauaaaagaccuucucaagauaaaguccaacaaagaugaagucaaccucucugagcuuagcaagcccguuagugagaucaaagacuugaucaaaaguaucuucgaaucgcuaaauauaaacacugcaauccucgacuucaacccggagcucgagggaaaagauuucgagcggcaagccagcuaccaacuauggcaccuccuauacuccuacgagggcgacaacuccaacacuggcaacgacgaauuguaccgacuccuauaccaaaaauuuggauucggcaaagaacacgcacagauucuagcaaaccucuccuuuucccaagacuacggcucgcucagcgcgaaggcaaugcgcaagaucuaccccuuuauaaaggaaaauucguacuccgaggcauguagcuuggccggguacaaccacuccucauccaucacaaaggaagagaacgauaaacgggagcuaaaagaaaaacucgaacucuuacccaaaaacucgcuccgcaacccuguagucgaaaagaucuuaaaccagauggugaacguaauaaaugcgauuauagcugacccaagcauggguagacccgacgaaaucaggaucgaacuugcacgcgaacugaaaaagaacgcggcggagcgagcagaaaugaccauacacaucaacaaggccaaaucggaacacgacaacuaccguaaaauccuaacaacggaguucggcauccccaaccccacgcgcaacgacaucauccgguacaaacuguacgaagaacugaaagucaauggcuauaaaacgcuguacaguaacacguacauaccccgggaaaaacuuuucucaaaagaguucgacgucgaacacaucaucccaaaagcacuauuguucgacgacuccuucucgaacaaaacgauaugcgcacgccaggaaaacuuagacaagggcaacaagaccgccuucgacuuuauacagucuuucuacggcaaggaaaaguucgaggaguaccuccagcgaauagaaucacuggcgaaaaucaaagagggcgacaccuucgugauuucgaaagcuaaauauaagaaacuccuccugccggaaaucgagauaggcgagggauucaucgaacgcgaccugcggaacucccaguacaucgcaaagaaagccaaauccaugcuccuagacaucugcaaaacggucgucccaacaaccggauccauaacugacagacuacgagaggacuggggcuuaaucaacauaaugcaggagcugaacuuugaaaaauacaaaaagcuaggccugauagaaauggucgagaagaaagacggcagcuucaaagaacgaaucaccgacuggacgaaacgaaacgaccaucgacaccaugcgauggacgcgcucacgguggccuucaccaaacacaaucacauacaguaccucaacuaccuuaacgcccggaaaaacgaaaaccacaagaugcauggcaauguaaucgcaaucgaacaaaaagaaaccgaacuacucguagacuccguagggaaaagaaaacguaaguucaaacugcccauaagcaacuuccgagaggucgcaaaaaugcaucuagaaaacauacucguauccuacaaggccaaaaacaaggucgccacgaaaaacaaaaaccgauucaaaaccaaaaacggagagaaaguaaaaaucgagcucacaccccgaggccagcuccacaaagagacgguguacggaaaaaugaagaaguacgaaacaaaagaagagaucauugggucgaaguucgacgaggcaacgauacucaaaguggcaaaccuugaacaacgcaacgcccuccuccaacggcucaaagaaaacaacaacgaccccaaaaaggcauuuagcggcaaaaacagccugaaaucgaauccacucuacuacggagucgacagcaagcccauacccgaaagaauaaaaauagucuggcucgaagacgauuacacuaucaggaaagaaauuaccccagauuuaaagauagacaaggucaucgacaucggaauacgacgaauacuagagaaccgucuagcggaguucaacggcaacgcaaaagaagcauucagcaacuuggagaaaaacccgaucuggcuaaacgagggaaaacgcauagcgaucaaacgaguuaccaucagcggagucaaaaacgccgaaacccuacauuacaaaaaggaccaccuagggcaugagaugcucgacaagcagggcaagcgcaucccaguugacuucgugagcaccggaaacaaccaccauguagcaaucuacaaagacgauaaguccgaccuccaggaaaaagucgucagcuucuacgaggccguagaacgcaucaaccaggagcucccgaucaucgauaagucauucaaucacgacuuaggauggcaauuccuguucaccaugaaacaaaacgaguacuucguguucccccgcgauggauucgaccccuacgagauagaccuacuuaacccugacaacuacaaaaucaucagccccaaccucuuccgaguccagaaaauagccaccaaaaacuacgucuucaaucaccaccuagaaacaaaagccgucgacggcgaacuucucaaaacgaaaaaggaccucucggacaucacuuaccgguucauccaaacacccgucaaucugaaaaacauaauaaaagucagaauaaaucacaucgggcaaaucgugaaaauaggcgaauacuga

SEQ ID NO: 6783 - RNA, 4218 nt, Artificial Sequence
  Cas9 variant
augaaaacuauacugggacucgaccucggcacgaacucgaucgguugggcgcuagucaaagaagccgaaaacucaaacgaaaaaucagaaauaaucaaacuaggcguccgagucaacccacucacggucgacgagaaaaccaacuucgaagccggcaggccacuauccacaaacgccgaccguacagcaaaaagaagcgcgcggagaaaccugcaacgcuacaaguugagacggaaaaaucucauugaccuccuuauaaagaaccaacuaaucgacaaagacacaccacugaccgaaaucgggaaaaacacaacacaccagacgcuggaacugcgagccaaggccgccagggagcguaucgagcuugaggaccuggcccgcguguuccucgcaauaaacaaaaagcgcggauaccgauccagccgaaaagucaacaacgaagaagaaggacaagccgucgacggaauggcaguagcgaaaaagcucuacgacgaaaaccuaaccccaggacaauacgccuacgagcuacuauccaaaggcaaaaaguaugucccagacuucuaucggagcgaccuccaggcggaguucaacgccauaugggaauaccaaaaacaauucuacgccgacauccuagacgacgagcuuuacaaugcccugaaagggcaaggccaacaaaacucgcgaaagagauuccucgccaucaaaggcgucuacacugccgagaacaagggcaaaagggacgacgugaaacuaagacacuacaaguggagauccgaggcgaucuccaaaaagaucaacaucgaggaggucgccuacguccuaguugaaaucaacaacgaccucaacaaguccagcggauaccugggcgcaauaucagaccgaucaaaagagcucuacuucaacaaggagaccguaggcgaaaaccuguggaagcaaauccagaaaaacccccacaccagccuuaaaaaccaaguuuucuaccgucaagacuauuuagacgaguucgaacagaucugggaaacccaagcccaauuccacccacaguuaacccuggcacuaaaggagcaaauccgcgacgucauaaucuucuaccaaaggaaacucaagucccagaaaggucugcucuccuucugccaguuugaaagcugggaaaucgagaggaaagacgagaacgggaacgucauucucaauaagaccacucaacuccccaaacgccagaccguaggccgccgggucgccccaaagagcucaccgcuauuccaagaguucaaaauauggcaaaacauuaacaauuuggaagugacaaaaaucagcgaaggcgcaucaaagaacaagaaagaaacugaaacccucucggaugaugaacgaaaacuucuguuugaggaacuaaaccucagagggaaccucagccagaaggaaguccuucaaauacugggcuugaaagacaaggaauacaaaaccaacuucuccgaaggccuggaaggcaaccgaacaaacgcggcccuauucaacaucuaccagcaaauagccgaaaacgaaggcuacggcuucgauuggucaaagaaauccgcacaggaaauaaaggaagaacuaaaggccgucuuuccgcagaucggcauacaagccgacauucuagacuucaacgccaaccuagacggcaaagaguucgaaaaccaagccuccuaccaacucuggcaccucuuguacucagccgaagaagacgacaaaauuaacgaagaagaccaaaucauuuacggcaacucagcggugucccuuaagaagaaacugugcgagaaguucggauucacaccugaauacgcaaaauggaucgccaacguaucucuacaggacgacuauggaaaccuguccacuaaagccaugcggaaaaucauaccguaccuaauagacggcaacgacuauucagaagcaugcgcccucgcgggauacaaccacagcaacagcuuaacuaaggaggaaaacgacaaucgugaauugcucgauaagcuagagcuacuccccaaaaacucccuacgcaacccaguugucgagaagauucuaaaucaaaugguaaacgucguaaaucagguaauugagaccuacggcaaacccgacgaaguccggauagaacucgcucgggaacucaagaaaucggcagaaaaacgcgcugaaaugaccaaaucaauuaacgaggcaacccgccgaaacgaggacaucaagaaacucaucacaaaagacuucggcaucccaaaccccacaaaaagcgacguaguaagauaccgccucugggaagaacuagcaccccucgcauacaaagacgucuucacaggcaaacagaucaaaaaggaagaccuguucucaagcaaaaucgacaucgaacacauuauccccaaagcauuacuuuucgacgacucuuucucaaacaaaacgcucgucuuccgggaaacaaacuuaaagaaagccgaccgcaccgcguacgacuucauagaauccgacuacaacgcuacacucgacgacuacauccagagggucgaaaccuuguauaacaacacaaaagggacgauaucgaaaggcaaacgcaacaaacuacuuauggcacagaaaaaccuucccgacggauucaucgagcgcgaccuacggaacagccaauauauugcaaagaaagccaaagcaauguuauaucaaguuuucaaagacgucaacgucacguccggcaguauaaccgaucgacuccgagaagacugggaccucaucaacguaaugaaagaacuaaacuuuccaaaauacaaagcccucggucucaccgaaauagaagaacgguacgacaucggccaagagaaaacuaaacgcgucgaagucaucaccgacuggaccaaaagaaacgaucaccgacaccacgccaugaacgcccucacagucgcuuucacaacauccagccacauccaauaccugaacuaucuaaaugccaggaaaaacgaaagucacaaagaacacaaaaacauaaaaggcaucgaaaacaaaauuacucacaaacagaaagacaagagaaaauucaucccuccaaugcccaacuuuagggaagaagccaaaaagcacauagaaaccauccuggucucgaucaaaaacaaaaacaaagucuacacgaaaaacaucaacaaaacaaagaagaaaagcgggcacaacaccaaagagcagcucacacccagaggacaacuccacaaagagacaguguauggcaagucgaagagacccaugucgaaaccaaccaaaaucaacaagaacuucagcuuggaacaagcccaauugaucauaaacgugcaggagaaagagcuaguacuacgccaccucgcgcaauucgacaauaauccagcggucgcauucgacacaaaaacgcuuaaaaagaugccccuacucaaaaacggagaaccccugaaagaaguccuuugcuucgaagaaauuuucacgauccgaaaagauauaaccccugaccucaaaaucgaaaaaguagucgacgagaaaaucaaggcgauccuagagcaacggaagaaagacuucggaggcaacgccaaagaagcguucucggacuuggacaaaaacccaaucuggcucaacaaaaagaaagggaucugcaucaagcgcguuaccaucacagguguuuccaacgcggaagcacuccaccaccaaaaagaccaucucggccgcgagauucucgacgacaaugggaacccaaucccagccgacuuugucuccaccggcaacaaucaccacuuggccguguaccuagauuccgaaggcaaacuucaagacaauauagucucguucuacgaagccgucguacgcaccucccaggggcucccuguugucgacaaaggacugaauaaagaccucggauggaaguuccucuuuucacucaagcaaaacgagauguuuguauucccaaacgaugacuucgauauaaacgacuucgaucuccucgaugacaagaaagcggaacucaucagcaaacaccucuaccgcguccagaaaaucucaaaagucucggcaggaaacucauucgugcgggacaucgucuuccgacaccaucucgaaaccaccguuaaagaaguuaaggagcuaaaagauaucagcuauauccaauuaaaaucgcucgagggacuccgaaacaucaagaaaguccgcauaaaccacaucggcaaaaucguccaagucggagaguacuga

SEQ ID NO: 6784 - RNA, 4221 nt, Artificial Sequence
  Cas9 variant
auggagaaaaagauaauaggaauagaccugggagucaccagcauagggugggccuacguaaucgaagacgagaauggacauucgcggauccucagaaucggcacuagagucaacccccuuacaacggaagaacugaagaacuuugaacagggaaaaccgaucacugagacagccgaacgcacccucaaacgcucuaugcgccgcaaccuacaaagauacaagcaacgacgcacuaaccuaaucaacguacuacugaagaacaaacucaucacagaaaccacggcacucgccgaggacggcaaaggcacuacgcaccugacacacgcgcuccgcgccaaggcagcguacgcacagauaccacucgaggacuucgcucguguacuccugaugcugaacaagaagcggggauacagaagcucgcgcaaagucaagaccgaagccgacgggcaggccaucgacgggauggccgucgcaaagaaacucuacgaggagaacauaacgccaggccagcuauguuacacccuccuucuacaaggcaagaaaacgcucccugauuucuaccgcucagaccuccaggucgaaauggaaaaaguauggaccuuucagaaacaauuccaucaggccauccugacugacgaguuccggaaguauaucgcgggaaagggacagcgagccacagcagcauccuucuggggaaaauacggauucaacacggccgaguucaagggcucacgagaagaaaagaaacuaaaaagcuacgaauggcgcagccaggcgaucaccaccccguuaagucaggaggaggucgcagcggucaucacugauaucaacucaaacaucgccaacagcuccggcuaccuuggagcgaucucagaucggagcaaagaacucuucuucaacaaacaaacagugggccaauaccaauacaaucuacuacaacaaaacccgcacacaaaucuaucagggcaaguauuuuaccgccaggacuaccucgacgaguucgaaacgauaugggagacccaagcaaccuuccacaccaugcuaacacccucccucaaagaggaaauuagagacaucguaauauucuaccagcguaaacuuaaaucgcaaaagaaauuagucucaauaugugaguucgaaaaacgcauacucgaaccacuccagggagacaaggucgugggguacaaaguggcccccaagucgagccccuuguuccaagaguucaagaucuggcaggcccuaggcagaauggaaauacaacacaaggucacaaaagaacgccacuuccucgaucuagacgcaaaacaacuacuauucgacgagcuaaaugucaaaggugaccuaaccaaagaaaacgcacucaccaucuuaggauucaagccaaaggaaugggagugcaaccugcuuaaacucgaaggcaaccgaacuaaccaagcacucuacgaggccuaucuaaaaauacuugagcucgaaggguacgaagucaaggaccuacuaggacucaagcuggacaaggacgacauaaagcuauccgaacucccagucgaugccgcugacauaaagaagaugguccgggagaucuucgagacgcuaaacaucaaaacaucgcuacucgacuucaacgcaacucuucccggaaaaucuuucgaacagcagcaugccuaccaacucuggcaccuccuauacagcuacgaaggagacaacuccccgucaggaaacaagaaacuccaagaccuccuccaagcuaaguucgguuucacaaacgcccacgggcaaauacuggcgaaugucagccuagagaccgacuacggaucccucagcgccaaagccauuagaaaaaucuuuacacacaucaaagaaaaccacuacucugccgccugcgcgcuagcgggcuacaaccacucaagcuaccuguccaaagaagaaaacgagcaacgcauccucaaagaccgacuaacaauacuaccgaaaaauucgcugagaaacccggucguagagaaaaucuuaaaccaacuuauaaaccuauugaacaccaucuucgacgaccccuaucucggaaaacccgacgaaauaagaauagaacucgcuagagagcucaaaaagaauguccaagagagacaaaggcuaaacaccgagauaaccaaaaauaacacagagcacgaacgcauaaccaagauacuaaucaaagaagacaauaucaaaaacccgacccgaaacgacauaauccgguacaaacuauaccaggaacugaaacacaacgguuauaaaacccucuacuccaacaccuacauuccgagggaggagcuauucggcaaaaacuuugacauagaacacauuauuccccaaagcauccucuucgacgacagcuuuagcaacaaaacacugugugucagaaaagaaaacaucgacaaagcagacagaaccgcaauggauuucaucggaccguacuuuggagaagacaagguccaagaauacaucaauagaguagaaaugcugcaccagauaaaccuaaagaacccagaagaaggaauaggcaaaggcaaauacaagaagcuccucaugaaggccucggagaucggacagggguucaucgaacgugaccuuagagacacccaguacaucgcaaagaaagcccgccaaaugcuccucgaaguaacacgaaccgucgucgccacaacagggagcaucaccaaacgacuccgcgaggacuggggacucgugaacgugaugcaggaauugaacauggacaaauaucgccaacaaggacuuaccgaacuaauagagaagaaagacgguuccacaaaagaacgcauaacagacuggacaaaacgcaacgaccacagacaccaugcgauggacgcgcucaccaucgccuucacaaaacacucccacauccaauaccugaacaaccuaaacgcgcggaaauccgacgacaagaaagggaaagaaaucuucgggauagagcagaaagaaacagaaaaagucaaagacgacacaggccaaacgcaacgccgcuucaaacugccaaugcccgacuuccgccaagccgcaaaacaccacuuagaacaccuucuuauuuccuucaaggccaagaacaaaguuuucacgaagaauaagaacaaauacaaaaccaaaaacggagagcaagucaagcuagagcucacgccgcgaggccagcuucacaaggaaaccauuuauggacgcaucaagaaauacgugacacacgaggagaaaguaagcagcaaguuuaaugcgcaacuaauucaaacagucgccaacuccaaauaccgauacgcccuucucaagcgccuagaagaaaacggaaacgaccccaagaaagcguuuacaggcaaaaacucucucgacaaaacaccucuauucguugacgcaacccaacaggagaaaaucccgcccguggucaaauuggucucuauugaacaaggguauacaauccgcaaagauaucacccccgaaaacuuuaaagaugcgaaaaguauagaaaagaucgucgacgucggaauuagaaaccuacugcaccauaggcuugaaaccuacaacggcaaugaaaaggaagccuucuacaacuuggacaagaaccccauuuggguaaacgagucaaaagguauuugcaucaaacgagugacuaucacuggggugacgaacgccgaaccccuccacuacaagcgcgaccaucacgguaagcccauacuggacaacaacggcaaccgaacgccagccgacuucguguccaccgggaacaaccaccacgccgccauauaccgcgacgcagccggaaaucuacaagacaacgucguuuccuucuacgaggccgucgcccgagucaaccaagggcucccgauaauagacaaaucgcucaacaaagaacuuggguggcaauuccuguucuccuuaaagcaaaaugaaugcuucguuuucccaaacgaaggauuugacccccucgaaaucgaccucuacaacccagccaacaacaagcugaucgcagcgaaccucuuccggguccaaaacuuuagccggcugcaauacggcaacaacaucauccgcgacuacaacuuucggcacaucuacgagaccucuguagaaaaccgcaaggagcuuaaagacaucgcuuacaagcaagucaaaucccuacccaucuuugagaaaaucauuaaaguccgaauaaaccacauaggacaaaucguaaaaacuggggaauacuga

SEQ ID NO: 6785 - RNA, 4224 nt, Artificial Sequence
  Cas9 variant
augauccguaauauccuaggccucgacuuaggcgucuccaguauuggcugggcauacguccaagaagacagcaaaaauuccgagaacaaccggaucauaaaacugggcguaagggucaacccccucacggucgacgaacagcuaaacuucgaaaagggaaagccgaucacuaccaacgcaggccgcacacucgccagaucggcaagacgcaaccuccagcgguuuaaacuccgcagaagcaacuuaauggacgugcucaagaaaaacaacauccuaaaggagacagaccuccuugcggagguaggcaagaauagcacauuucagacacaagaacuaagagcuaaauccgcgaaagaaaagaucgaacuauccgaguucgcacgcguguuguuacugaucaacaagaaaaggggauacaaaucguccagaaaagccaaaaacgacgaagacggacaaauagucgacgguauggcagucgccaaaaagcuguucgaggaaaaccuaacucccggagaguacagcuaccaacuccuacaacagggcaagaaacagcuccccgacuucuaccggucagaccugcaggcggaguucgacaaaaucugggacuuccagaaacaauucaaucccgaaauauuuacaaacgaacuguacgaaaaacuccaaggaaagaaccggaacgcuacuuggaaggaacucgaguucccguuuucacucgucggaauaaagcaaacgggcacgaugcaggaaaagaaagucgaaaaauacuuuuggcgaagugaagccgucaagaaacaacuagacuuugaaagccucgcaguagucuuccaggagaucaacuccaaccuaaacaacaguuccgguuaccugggcgcaaucuccgaccgcuccaaagaacuauacuucuacaaccagaccgucggcgaguaccuguuccaacaacuaaagacaaauccacacaccaaacucaaaaaccaaguguuuuaccgucaagacuacuuggacgaguucgaaaagaucugggaaacacaguccaaguaccacaaggaacuaaccaaagaacuuaaagaagaaauccgcgacaucacgauauuuuaccaaagaaagcuaaagucacagaaaggccuaauuagcauaugugaguucgaaaaccgcgagaucgaaaucacagaaaacgguaaaaccaagaagaaaacugucggucuaaaaguggccccgaaaucaagcccccuauuccaagaguucaaaauuuggcagguacugaacaaccugcaauuccagaacauagagacaaaagaaguguucccuaucgaccucgacuucaaacagucgauuuucgacgagguaaacaucaaggggaaacugagcgcaaaagacgugcucgacuuaguuggauacuccgguaaagaguggaaaacaaacuucaaagaaauagaagggaacuacacaaacgagaaccuauacacagcuuuccuaaaaauaauagcuagcaaagagauagaguuccccaaggaguucaaaaucaccaucgacgacgaaauaaaagucuccaaaauaaacgccuccgccgaaaucaucaaacuauucguccgcgagaaguucagcgaauugggaaucgacacuuccauccucgacuucaacccggaacuagaggggucggacuuugagaaacaagcaagcuaucaacuauggcaccuccucuacagcuacgaaggggacgacucaucaucaggcaacgagaaguuguacgaacuucuagaaaacaaauuuggcuucaagaaggaaaacucgaaaaucuuggccgagaucggauucucgcaagacuacggcucacucuccagcaaggcaaugagaaaaaucuaccccuacauaaaagagcacaaauacucaguggccugcucguacgcgggcuacaaccacagcaagaacucacucaccaaagagcagcucgaaaacagaauccuuaaagaacgacucgacauccucccaaagaacagccuccgcaaucccguagucgagaaaauccucaaccaaaugaucaaucuagucaacuguuugaucgacgaauacagugaaaaagacaaagacggacagauagucaaauacuucaaguucgacgagauccgaauugaacuagcccgggagcugaaacugaacgcagaagaacgcgcaacaaugaccagcgaaauuaacaaagccacgauccagcaccagaaauacgcagaaguccugcaacgugaguuuggccugaaagcacccagccgcaaugacaucauccgauauaaacucuaccucgagcucgcaaauaauggcuuuaaggaccuauauacagacgcaaagauagagagagagaaccuauucacugacaaguacgauaucgaccacaucaucccccagucccgcuucuucgacgacucuuucucgaacaaaguucucgucccccgcaaugccaaccucaagaagggcaacuucacagcguucgacuaccuagaaaucgagggaaaggaaaaacuggaaaaauuccuaaauauaauaaaggaucuauacgauaaaggggccaucaccaaagccaaauacgaaaaguugcaaaagaaagacuuugaaaucggggacggauucaucgagcgcgaccugcgcaacacccaauacauagcgaagaaauccaaagagauccuguucggaaucaccaacucagucguaaccacguccgggcgcauaaccgacaaacuacgagaggacuggaaccugaucaacacaaugaaagagcucaaccucgaaaaauaccgcaagcucggccucacggaaacagucauuaacuccaagggcgaggaaaaacaaaggaucaucgacuggacgaagcgaaaugaccaccgccaccacgcuauggacgcacucaccgucgcauucacgacccacaaccauauccaguacuugaacuaccugaacgcccgcaaggacgagaaacacaaagaacaccaaaacaucuucgccauagaaaaccuaaucaccgagauaaucgacaagaaaaauggcagcaaagaacggagguucaaagagcccguuaaaaaccugcgggcagaagcccgcaagcaccucgacgagauccuaauuucacacaaagugaaaaacaaaguagucaccaaaaacauuaacaagaucaagaagaagggcagcguaaucgcaaaaacagagcuaacgccacgaggucaacuccacaaagagaccauauacggaaguagcaaguuccucaaaaccaaggaagagaaaauaagcggcaaguucgauguggaaacaauccagaaaguccaaaacgaacgguauaggaacgcccugcuaaaacgccuacaagaauuuggcggcgacaguaagaaagccuucacagggaagaacguuaucucaaagaaccccauauuccucaacaacgaaaagaccgaacaacucccggagacuguaacacuagcgugguacgaaaugggauacacgauccgaaaggccgucaacccugacaacuucaaggauuucaaaaacaucgagaaaaccauagauaaggggauccgagacauccugacaaagcggcugaaagaguucaacgguaacucgaaagaagccuucucagaccucgacaagaaucccaucuggcuaaauaagucaaagggaaucuccaucaaagccguuacgaucaccggaauaaacaacgcagaagcccuccacuacaagaaggaccaucuuggcaaggacuuccuggacgaaaacggaaaaaggaucgcgguagauuucguaucaaccggcaacaaccaccacguugcaaucuacgaagacgaaaauggaaaccuacaggagaaaguagucagcuucuacgaggccguugagcgcgucaaccaaaaccugccgauaaucgauaaggaguacaacagcgaaagcggcuggaaauucuuauuuaccaugaagcaaaacgaaauguuccuauuuccaagcgaagacuucaaccccaaagaaauggaccucuucgacgaaaagaacgucaaccucaucuccaaaaaccucuuccgaguccaaaaguucaccaucaaagacuauuucuuccgccaccaccuagaaacaaacguagaggacagcuccccgcuuaaaggcauaaccuggaaacgggaaggccuaaacggaauagagaacauacugaaaguucgacucaaucaccuggguaaaauaguccagaucggggaauauuga

SEQ ID NO: 6786 - RNA, 4227 nt, Artificial Sequence
  Cas9 variant
augaccaagaauauccuaggccuugauguagggguauccucaaucggcugggcccucauaaacgaagacauagaaaaucccaaaaacaacaagauaaucaagcuaggggugcgcgucaacccgcucaccguagacgagcaaaucaacuucgaaaaagguaaacccaucaccacgaacgccggacgcacacuugcgcgcggagcacgccguaaccuccaacgauucaaacucagacgcuuucaccucaucgacauacuacaaaagaacaacauccuaaaacaggccgaccucuuggcggaagucggcaagaacagcacauuccaaacgcaggaaauccgagccaaguccgccaaacaaaaaguggagcucucggaacuagcccguauauucuuauuaaucaacaaaaagagaggguacaagagcucccgaaaggcuaagaacgaagacgagggccaaaucaucgacgguauguucauagccaaaaagcucuacgaugagaaacuuacacccggagaauacaguuaccaacuacugaaagaaucuaagaaacagcugccagacuuuuaccgcagcgaccuccaaagcgaguucgauaaaauauggaauuuucaaaaacaauucuacccagaaaacuuuagcgacaaccucuacaaagaacugcaagggaaaaacaaaaaugcgaccuggaagacccuggagaucccauucagccuagucggaauaaagcaaacgggcacacugcaagaaaagaaacuagagaaauauucauggcgcagcgacgccguaaagaagcaacucgacuacgagaaacuagcggugguguuccaagaaaucaacuccaacauauacaacagcagcggguaccuaggcgccaucagcgaucggagcaaagagcucuacuucaacaaucaaacugugggagaauaccucuacaaccagaucaaggagaacccgcauaccaaacugaaaaaccaagucuucuacagacaagacuaccucgaugaguucgagaaaauaugggaaacccaaaguaaauaccacaccacccugacgaaggaacugaaggaagaaauacgcgacaucauaauuuucuaccaacguaaacuaaagagccagaaaggauuaauaucuaucugcgaguucgaaaaccgcgaaauugaaauaaaggaaaacgguaagaucaagaaaaagacagugggccuuaaggucgcgccuaagucaagcccauuauuccaggaguucaaaauauggcaaauacugaacaaccuccaguuccagaacaucgaaagcaaagagaucuucccaaucgaccucgacuucaaagaauccauauucaacgaggugaauauaaaaggacgcaucagcgcuaaagcaguccucgaccuacucggcuacagcggcaaagaauggaacccgaacuuuaaggacaucgaaggcaacaacaccaacgagaaucuauacaacgcuuacuuaaagaucauagcggacgaagaguucgaacuccccaaggaguucaaguugaacggcgacgacgaccuauacguaagcaaaauagcgugcucagcauccaaaauaaaagacuucgucaaggaaaaguucucagaaauuggcaucaauacaaguauccuggacuucaacccagaacucgaagguaaagacuucgaaaaacaagcauccuaccaauucuggcacuugcucuacuccuacgagggcgacgacucccaaucggggaacgagaagcucuacgagcugcuugagaaaaaguucggauuuaagaaggagcacagcaaaauccuaagcaacauuggauucccccuagacuacgggaacuuaucaacuaaggcgaugagaaagaucauuccgcaccucaaggccggacucagcuucgcgaagaaaagcaaagaggacaacauucucucagccacagcgauggcgggcuacaaccacaguaacagcuacaccaaagaagaccuagcaaagcgaguacugaaagagaaacuggaagucuuucccaaaaacucgcuacggaacccaguggucgagaaaauccucaaccagaugaucaaucuagugaacgaggcagucgaagaauacggcacgauagacgagguccggauagaacucgccagggaacuaaagaaaaacgcagaggaacgggccaacaugacgagcgagaucggaaaagccacgcugcuccaccagaaguaugcagagauauugaagaaagaguucgacaucccugucccaagcaggaacgacaucauucgcuacaaacucuaccuagaacuagcgaacaacggauacaaagaccucuacaccgacguccagaucaagcgcgaggaacuuuucaccaacaaguacgacaucgaccacaucaucccgcaguccagauucuuugacgacaguuucucaaacaaggucuuagucccaaggggcgcgaaccucaagaaggccaaccaaacggcguucgacuaccucgaaaacgaagacaagcagaaacucgaaaaguuccuaaacauaaucaaaaaccuuuacgacaagggcgagauaacgaaagccaaauacgagaagcuacagaagaagggcuccgacaucggcgagggcuucauagaacgcgaccuacgugacacccaauacauagcaaagaaagcgaaagaaauucucuucgggaucacacacagcgugaucagcaccucggggaaaauaacugauaaacuucgcgaagauuggaacuugguaaauacaaugaaagaacucaaccuggacaaauacaagaaacuaggccucaccgaaacacuacugaacuccaaaggcgaagagaaagagagaauaaucgacuggucaaagcggaacgaccacagacaccacgcgauggacgcucucacaguggccuuuacaacgcauaaccacauccaauaccugaacuaccugaacgcacguaaggacgaggaccacaaacagcacaaggugaucuccaacauugaaaaccucaucaccaaggucuucgaaaagaaaaacggcgcgaaacagcgcagguucaucgaaccgaucaacaacuucaggguagacgcaaagaaacaccucgacgagauacuaaucucacacaaagcgaaaaacaaagucgucacgaaaaacauaaacaaaauaaagaagaaaggcagcgucguggccaaaaccgagcuuacuccccgcggccagcuccauaaagaaaccaucuacggaaguucaaaauuucucaaaacuaaagacgagaaaaucagcggcaaauucgacuuggaaacaauaaacaaggugcagaacgagaaguacaagaaugcccuccugcaaagacucagagaguucggagaagacuccaaaaaggcauucacaggcaaaaacgucaucuccaagaaccccauauacuuagacgaggagaaaacccuucaaauacccgaaagcgucacacuggccugguacgaaaugauauacacaauacgaaaaccaguaaaucccgacaacuucaaagauuacaaaaacauugacaaggugaccgacgagaagauacgagcgguacucaccgacagacuaagaaaauucaacgggaacagcaaggaagcguucucugaccuggagaagaacccaaucuggcuaaacaaaaguaaggguaucgccauaaagaccguuacaaucacuggcaugucuaauguagaggcacuacacuacaagaaagaccaccucgggaaagaaaucuuagacaagaaaggagaccgaaugccaguagacuuugucaguacagggaacaaccaccacgcagcaauuuacgaggaugcaaaaggaaaccuccaagagcgggucgucaguuucuacgaagccguggaacgagugaaccaggggcugagcgucgucaacaaagacuacaaugccggccugggcuggaaauuccuauucaccaugaaacaaaacgagauguuucuguuccccagcgaagacuucaaucccaaagaaauagaccucuacgacgaaaagaaccugaagcuaaucgcaaagaaucuauuccguguacaaaaauucggggagcuguccaaaucaggcuucugguucagacaccaccuagaaacaucugucgacgugaagaaagaacuccguaacuacuccuaccuagacuucuacagcaaagacuucaugaaaaccaucgugaaaguccgccucaaccacuuaggcaagauaguacaggucggggaauacuga

SEQ ID NO: 6787 - RNA, 4230 nt, Artificial Sequence
  Cas9 variant
augucuaucaucaacuuccaacgaagagggcucauggagacccaagccagcaaccaauuaauaagcucccacuuaaaaggguacccgauaaaagacuacuucgucggccuggacauaggcacaucuagugucgggugggcaguuacaaacaaggcuuacgaacuacucaaauuccgaagccauaagauguggggaucacgacucuucgacgaaggcgagucagccguagcacgccggggauuccgaagcaugcggcggcgcuuagaacgccgcaaacuaaggcugaaacugcucgaagaauuauucgcggacgcaauggcucaaguagacccaaccuucuucaugagacuccgcgaaucaaaguaccacuacgaggacaagaccaccggccauagcagcaaacacauccuauucauagauaagaacuacacggaccaggacuacuacaaagccuaccccacaaucuaccaucugcgggcggaacucaugaaggacggcaccgacgacaucaggaaacucuuccucgccgugcaccacauacuuaaauaccgaggaaacuuccucuacgaaggggcaacauuugacagcaacgcgucaacacucgacgacguuaucaagcaagcacucgaaaacaucacauucaacugcuucgacugcaacagcgcgaucagcucgauuggacaaauacucauggaagccgggaagaccaagagcgacaaagcuaaagccaucgaacaucugguagauacauauaucgcaaccgacaccguggacaccagcagcaaaacacaaaaagaccaaguaaaggaagacaaaaagcggcucaaggcuuucgcaaaccugguucuuggccuaaacgccucauugaucgaccuauuuggaucgguagaagaacuagaggaagaucucaaaaagcugcaaaucaccggcgacaccuacgaugacaagagggacgaacucgcaaaggccuggucagacgagaucuacaucauagacgacugcaaaagcguauacgacgccaucauccuccugagcauaaaggagccuggacucaccaucagugaauccaagguaaaagcauucaacaaacacaaggacgaccuagcgauacucaaaucacuacuaaagucagaccguucgauauauaacaccauguucaaagucgacgaaaaagggcuccacaauuauguccacuacaucaaacaggguagaacagaagaaacuucgugcaaccgagaagauuucuacaaauauacaaagaaaguugucgagggccuaccugacucaaaagacaaagaguacauccuauccgaaaucgagcuccagacgcuccucccccuccagcgcaucaaagacaacggcguuauccccuaccaacugcaccuggaggaacuaaaaguaauccuggcgaaaugcgguccgaaauuccccuuccuuaacgaaguugccgacggcuucucagucgcugagaaacuaaucaagaugcuagaguucaggauaccauauuacgucggcccccuaaacacacaccacaacguagauaauggcggguucgcuugggcagucaggaaggccagcggccgcgucacccccuggaacuuugacgacaaaaucgaucgagaaaagagcgcagcggccuucaucaaaaacuuaaccaauaaauguaccuaucuccugggagaagacguguuacccaagucgagccuucucuacagcgaguucaugcuccugaacgaacuuaacaacgugcgcauagacggaaagccccucgaaaaggcugucaaagagcaccuaaucgaagcagucuucaaacaggaccauaagaaaaugacgaaaaaucggauagaacaauucuuaaaagacaacaacuacauccccgaaaaacauaaaccagaaauuacaggacucgacggcgagaucaaaaacgaccucgcuuccuaccgggacauggugcgaauauugggaaacaacuucgaccuaucaauggccgaagagaucauuacugacauaacgauauuuggagaaagcaagaaaaugcuacgcgaaacccuacgaaacaaauucagcagcaggcucgacgacgaggcuaucaaaaagcucagcaagcugagauaccgcgauuggggacggcugucccgaaaacuucucaacgucauagaaggaugcgacaaagcuggugacgguacccccgaaaccaucaucauccucaugaggaacuucucguacaaccuuauggaacuuuuaggagacaaauucucauucauggaaagaauccaggagaucaacgcaaaauugaucgaaggccaaaucguaaacccacaugauauaauagacgaccuagcauuaagcccagccgucaagagggcaguauggcaagcccuccguauuguagacgaaauaguccacaucaagaaaacccuuccggcccgaaucuucgucgaagugacacgauccaacaaagcagagaaaaagaagaaagacagccgacaaaaacgccuuuccgacuuguacgccgccaucaagaaagaugaugcccuacugagcggccucacgaacgaagaguucggagggcuuaaaucaggacucgcuaaauacgacgacgcagcacuccgcucuaagaaacucuaccuauacuacacccagauggguaggugcgcuuacaccggcgaggugauagaucucucccagcucaacaccgacaacuacgacaucgaccacaucuacccccguucgcugacuaaagacgacagcuucgacaaccuagugcuaugcaaacgcacagcuaacgcucaaaaaucagauacuuacccgauuagcaaagagauucagaaagcccaaaaggcuuucuggauauuccugaaacagcagggacucauuucagaacgaaaauacgaacgccucacacgcaucacuccccucaccgcggacgaccuuagcggcuucauagcccggcagcuaguagaaacaaaccaaucagucaaagcagccaccacccuucuacgccgccuguaccccggagucgacguagucuucgucaaggccgagaacguaaccgauuuccggcacgacaaugacuucaucaaaguaaggucccucaaccaccaucaucacgcaaaagacgcauaccucaacauagucguagggaacgucuaccacgaacgcuucaccagaaacuuccgcgcuuucuucaagaaaaacggcgccaaccgaaccuacaaccucgccaaaauguucaacuaugacgucaacugcacaaacgcaaaagacggcaaagccugggacguaaaaacauccauggacaccgucaagaaaaugauggcaucgaacgacgugcgcguuacgaaacgucugcuagagcaauccggagcccuggcagacgcaacgguauauaaagccgcgguugcagaaaaagcaaaagacggcgccuacauuggaaugaaaacaaaaagcaguguauucgcagacguaucuaaauacggggguaugacgaaaaucaaaaacgcauacuccaucauaguacaguacgcagggaagaaaggagaggucguaaaagaaauagugccgcuaccaauauaccuaacaaaccgcaacaccaccgaccaggaccuaauugacuacgucgcuucaauaaucccacaggccaaagacauaagcaucaucuacaggaaacuaugcaucaaccaacucgugaaagucaacggcuucuacuacuaccuagggggaaaaaccaauuccaaauucuguauagacaacgcaauacaaguaauagucuccaacgaguggauccccuaccucaaggugcucgaaaaauucaacaacaugcgcaaagacaacaaagacuuaaaagcuaacgucauuucaaccagagcacuggacaacaagcauacuaucgaaguacgcauuguggaggagaaaaacauagaguucuuugauuaccucgucuccaaacuaaaaaugcccauauaccagaaaaugaaaggcaacaaagccgccgaacuuucagaaaagggcuacggacuauucaagaagauguccuuggaagaacaaagcauacaccucaucgagcuacuaaaccugcuaacaaaucagaaaacaaccuucgagguaaagccguuaggaauaaccgccucgagaucaacagugggcuccaagaucagcaaccaagacgaguucaaagucauuaacgaaucgaucacuggccucuauucgaacgaagucacaaucgucuga

SEQ ID NO: 6788 - RNA, 4233 nt, Artificial Sequence
  Cas9 variant
augaccaaaaacauacuaggccuggaccucgggguaucaucaaucggcugggcacucguccaagaaaacagcaaaaacccggaaaacaacaaaaucguaaaacuuggcguccguguaaacccucucacggucgacgaacaaauuaacuucgaaaaaggcaaacccauaaccaccaaugcaucccggacccuagcccgcuccgcccgaaggaaccuccaacguuuuaaacuuagacgagcaaaccucaucgauguccuaaagaaaggcaacauacugaaacaaggagaccuacugaccgaaaucggcaaaaauagcacauuccaaacgcaagaauugcgagcaaaaagcgcaaaagaaaaagucgaacucucagacuucgugcgcauccucuuacucaucaacaagaaacgaggcuauaaaucgucgcggaaggccaaaaacgaagacgaagggcaaaucauagacgggauggccgucgccaagaaacuguaugaagaaaauaucaccccaggggaauacuccuacaagcugcuccaagaagggagaaaacagcuccccgacuuuuaccggagcgaccuacaagcggaguucgacaagaucuggaauuuccagaaacaguucaauccagaaauauucaccaaugaacuauacaaacgccuacaagggaaaaaccgcaacgccaccuggaaagaacucgaaauccccuucuacuuggucggaauuaaacagaucggcacaaugcaagagaagaaaauagaacgguacuucuggagauccgaagccgucaagaagcaacucgacuucgaaucacuagcaguuguauuucaagaaaucaacucaaaccuaaacaacagcaguggcuaccucggcgccaucagcgaccgcucaaaagagcuuuacuucaacaaccaaaccguuggcgaguaccuguacaaccaacucaaaaucaauccccacaccaagcucaaaaaccagguauucuacagacaagacuaccuagacgaguucgaaaagaucugggaaacccaagcgaaguaucacaaaaagcuaacgaaggagcuaaaagaagaaauccgcgacauaguuauauucuaccaacgcaaacuaaaaagucagaaaggccucaucagcuucugcgaguucgaaaacagggaaauagaaaucaccgucaauggcaaaacgaaaaagaaaacugucggguuaaaaguaguacccagaucaucaccacucuuccaagaauuuaaaauuuggcagagacuaaacgaccucgaguucaaaaacguagaaaccaaagaaauauucccgcuagagcuagagcacaaggaaauacucuucggaaaccuaaauaucaaaggaaaccuguccagcaaagaguugauugagcagcucggcuacccaagcaaagaguggaaaugcaacuuuaaggagauugacggcaacaaaacgcacgagaaucucuauaccgcauuccucaaaaucaucgccaacgaggggaucgaauuucccaaggaguucaaacuaucgaucgaugacgacauaaaggugagcaaaaucgacguaucgagcgaaaagaucaaagaguucauaaaagaaaacuucuugaagcuaggcauuaacaccuccauacuggacuucaaccccgaacuagacggcaaagacuucgagaagcaagaaagcuaccagcuguggcaucugcuauacuccuacgagggcgacgacagcgcguccgggaacgaaaaacuauacgaacuccucgaaaagaaauucgguuucaaacgcgaguacucgaaaauacucgcagacgucggauucucgcaggacuaugguucacucucgucaaaagcuaugcggaaaaucuucacauacaucaaagagaacaaauacagcgaggcuugccaccucgccggauacaaccacagcaaaaacucguugacaaaagagcagcuggcaaaccgcauccucaaagagcagcucgaaauuuugccgaaaaaugcgcugcgaaacccagucguagagaaaauucucaaccagaugaucaaccucgugaaugaagucaucaaagaguacggcaagccagacgagauacgaaucgaacucgcccgggagcuuaagaaaaacgccgaagaacgugccaacaugaccagcgacaucuccaaagcgacgcuccuacaccaaaaauaugcagagguccuccaaaaagaguucggcaucaaggcaccaagccggaacgacaucauccgguacaaacuauaccucgagcuugcaaacaacggguacaaggaccuguacacgaaccagaaaaucgaaaaggaaaauauauuuaccgauaaguaugacauagaccacaucaucccacagagucgcuucuucgaugacagcuucaguaacaaaguacuggugccacgcugcgcgaaccaagacaaggacaacuacacagccgucgacuacaucgagaagaaauacggagaaagaggcaaagaagacuuccuaaaccgaauacaccucguauucaaaucaaaagaggcuauugcgggaaagagcgagucccagaucucguccaugaacaccaaauuccuaaaacugcagaagaaagggucggagaucggugaaggauuuaucgaaagagaucuaagagauacacaauacaucgcgaagaaagccaaagaaauccucuuuggaauaaccaacuccgucauuuccacuagcggaagaauaacagauaaacucagagaagacuggaaucuggucaacacaaugaaggagcuaaaccuagagaaauacaggaaacugggccucacggaacuaaucgcuaauucaaaaggcgaagagaaagagcgaauaauagacuggacgaaaagaaacgaccaccgccaccacgcgauggacgcccugaccguggccuucaccacucauaaccacauccaauaccucaacuaccucaacgcccguaaagacgaaaaacacaaggagcaccacaacauuuucgccauagagaauauaauaacagaaauugucgagaagaaaaacggcucgaaagaaaggcgcuucaaacucccaaucaaaaacuucagaacggaagcgaagaaacaacucgaggagguuuuaaucagccacaaagccaaaaacaaaguagugaccaagaacauaaacaaaaccaaaaagaagggcggggucgugagcaagaucguucucacaccccgggggcaacugcacaaagaaacgaucuacggcucggcgaaauuucucaaaacgaaagaagagaaaaucaguggaaaauucgacuuggaaaccaucaacaaaguccagaacgagaaguucaagaaugcccuccucgaccgacuaaaagaauuuaacggcgauucaaagaaagccuucacagggaaaaacgugccggccaagaacccgaucuaccuuaacgagcagaaaaccgaacaaguaccagaaagcguaguacuugcgugguacgaaacuggauacaccauccggaaagccgucaacgccgacaauuucaaggauuacaagaaccucgaaaagaucauagacaagggcgucaaagaaauacugaaaaaccggcucaacgccuucaauggcaacgccaaggaggcuuucagcgaccucgagaagaaaccuauauggcugaaccaauccaagggaaucgcagucaaaacagucacaaucaccggcaucaacaacgcugaaacgcuccacuauaaaaaggaucacuucggaaacgaguuacucgacgaaaacgguaagaagaucccaguggacuucgugagcaccggaaacaaccaccacguagccaucuacgaggaugccgauggcaaccuccaagagcgcguagugagcuuuuaugaggcaguagaacgagucaaccagggacucaguaucauagacaaagaauacaaccaggaccucggauggaaauuccuuuucacaaugaaacagaacgaaauguuccuguuccccuccgaagacuucaaccccaaagagaccgaccuguucgaugagaaaaaccuaaaccuuaucagcaaaaacauguuccggguccagaaauucggaagccuccugagcggguucugguuccgucaccaccucgagacaacuguagaccugaacuccucacuaaaagacacgagcuauaaagucauacaaucaugcaacaaccucaaacuaaucguaaaaguccgacuuaaucaccuuggcaaaaucgugcagauuggagaauauuga

SEQ ID NO: 6789 - RNA, 4236 nt, Artificial Sequence
  Cas9 variant
auggucaagaaagaguacuucaucggguuagacaugggaaccuccucagucggaugggcuguagcggacacgaauuacaacuuacuccgagccaaaggcaaagacauguggggcgugagacucuuccccgaagccagcacugcagccgauagacgcucgcaccguaccgccagaaggaacaacaaacguaaggcggcaagagagggcuuccuccgugaaaucuucgaagaugaaauaaauaagaucgaccccggcuucuucgaaagacugaaggaaaguaaauacuaccuagaagacaaacucacagacacgccauucguacucuucgcggacaagggauacaccgauaaagaauacuacgacgaauacccgaccgucuuucauuuaaucaaagaacucauauccgagaaaggucucgagccacacgacauccgacugguguaccucgccugcuugaacaucuacaagcaccgugggcacuuccucaacgacacgcugagcggagauggcauagacaacaucaacucgcucugcaacgacuucacaagcuaccucgccgacuacaaccaaaauucggaagacgacggaaccgagaaaauggaccucgacagcacgguucuggcgggaguuuucgaagagacacucuguaacaagcaccucuccaacagcgcaaagaaacgagaccuaauagacaaacucggaaucacgaacaagacgaaauaccucacagaaaugauggcgcucauuagcgggcucgccuccucagucagcaacauguucgccaaggacaccuacgacgaagaacagaagaaauuuaaacugagcuuccgaagcucaaaccucgacgaagacauggucaaaguucaagcgaugcucaccccggaagaauacgagaugauuuguauaaugaagaaaauacacgauuggagcgucguauccgucauaaugggaagccacaaauacauaagcgacgcgcggguagagcucuaugaaaaacauaaacaggaucucgccaaacucaaagccauauauaaagaauaccuaccagacaaguacgacgcaauguuccgcgagaugacggacaacuccuacucggccuaugugggcaaaguaucguccaacaagaaaagccaaacaggaaaccacaaaguccgcaugcaacggcgcggugcaaaaugcaagcaggaagacuucuacgaccgcauaaagaaagaaaucaacucgguaccccaagaggagaaaaucgauauacuacaagacauggaaaccaacagcuuccucccuaaacaauuaaccaacgaaaacggggugauaccguaccagcuccaccuagccgaacucaagaaaauacuggacaacgccuccaccuaccuacccuuccuaaacuccgcggacgaaacuggcaucuccaacaaagacaaaaucauccaauuguucgaguuccgcaucccuuacuaugugggaccccuauucaaaagugaaaagaacaaaacaaacgcuuggguggugaggaaagaaucaggcaaagucuacccguggaacuucaacgaaaagauagaugaaaaacaaagcgcagaaaucuucauagaacggaugguacgccacugcacauaucucaauaacgagagcgcccuccccaaaaauucccuaaaauacgagcguuuucgcgugcugaacgaacugaacaauuuacgaauaaacggugagcggaucagcccagaacuaaagcaaaggauauacaacgaacuauucaaagugaaaaagaagcgcaucacaaaaucaaugcuaugcgaguaucuguacaagaacggcauagcggacaaagacucggagcucucuggcuucgacggcacauucgccaacgcuuuacuaagcuacggcaaauuccgggaacucuucaacgucgacacccucacggauaagcaagaggcagcagcagaagacaucaucaaauggagcacaguauacggagacagcaagaaauuccuccaggagaagaucgaagagaauuacggcccagagucggaaaacccacuacucgacaacaaacaaauaaagcgcgugaugggcuacaaguucacugacugggggaaccuaagccgggaguuccugaaccuggagggagcagacaaggauaacgacacaaccacgggagaaguuaugccacuaauaacccgaaugugggaggagaacuacaaccuaauggagcucaugagcaacaaauucucauaccgagacgcacuggccgaaaagacggaggaaauagaaaagacccugacagacauugaauacgaagaccuggaggauuuguacaucagugccccagucaaaagaaugaccuggcagacauugcuaauccucaaagagaucuaccagaucaugggcuacgcaccgaagaaaauauuuguggaaauggcuagagaggaggaagaaaaagugaacggcaaaggcgcgagaaaguccucccguaagaaaaggcuggaggaccuguaccgcaauuguaaagacgcaagcaaggagcucuccaccggcaucaaaaacgcggacgaagccauccuccggaggaagaaacuuuaccucuacuaccuacaaaaaggcaaauguauguacagcggaaaaacuaucgacuucaaaagccucuucacaaacaacuacgacaucgaucacauauacccacaaagcgucgugaaagacgacucccuggaaaacaacauggugcuaguagaacgcaacuacaacaauaagaaaucggacacauuccccauauuuagcgacuggcaaaauaaaaugaagcccuucuggaccaugcuaaaggaacaaggauuuauaaaugaggaaaaguauaaacgccuaacccgcacggacgaacucacagacgacgaacuggcaaacuucgugaacaggcagcuaguggagacccgacaagcaaccaaaguaaucgccgaacuacugaaaaauucauucgacgauaucgacucgaagauagucuacgccaaagcaggcaaugugucagaguuccggcacaaguuuagcaugaaguacgacaaggaaaccgaaaagagcagcgucauccaccccgaauuaguaaaaugccgcauaauaaaugacuuccaccacgcaaacgacucauaccuaaacaucguaguuggcaacaucuaugacgucaaguucacccaaaacccauacaauuacaucaaagaguacaagaagcagaaaaacaauuccgcacucucagaacaagaaaaagagaaauaccacauggauaagaucuucaacuucgacguaaagagaaacggcgaaguggccuggauuuccagaggagacaauaagacccuugaaacgguacucaaagucaugcggaaaaacacccccaucgucaccagaaugaacuucgaggagcacggccaauuagcggaccucacuaucuacuccgcaucagacgcacuguccaaaaagggcguagguuacauaaaagucaaagccucggacgcgcgccucgauguccucaaauacggcggguacaaaaaguauaaaggagccuacuucuuccuggucgagcacaccgagaaaaacaagcgagugcgcacgaucgaaaauaugccucucuaccucaaaaacgaacuaaacaccaaagagaaaaucgaacucuggugugccgacaaagaaaaugggcuaggccucguggauccggauguccgcuuagggaaaaucaaacucuacaguaagauucggauagacggauucgaccuguaccucacaggacggacaggaaacaaucugcucaccaguaacgcgguccagcuaaagaucggaagcaacaaaccgagcgacaacgauaagcuguucuggagauacuauauaaacaaacucagcaaauacacggaaaacagcgaauuugucagcauacaaaauaacaucaaauuguacgaucuguucgucgagaucaauaacgccggggucuacagcaagcggcaaaaucccaucggugacaagcuacuugagggcagguccaaguucaucaaccucacacuaagcaaacaggucgaaacacuacuuggaauaauccggaucuacucacuggagaaccagggagcagaccucucaaacaucggaggccaagagaaaaacggaaccaugaagccccacaaacgcauaagcgacaagaaagaaguccuccuaaucaaccagagcguuacgggacuauacgagucaaaaaucgaccuccucaagaucuga

SEQ ID NO: 6790 - RNA, 4236 nt, Artificial Sequence
  Cas9 variant
augaaaaacauccucgggcucgaccucggcaccaacagcaucggcugggcgcuaaucaagcagaacgcugaggagcgccaaggcucaauacucggaaugggcacucgcguccuccccaugagccaagacguccuuggagacuucgggaagggcaacagcguaucccaaacagcggcacgcacaggauaccgagggauacgacgguuaagggagcgcuuccuccuccgucgagaacgccuacacaggguccugaauaucuuaggcuuccugccauacuacuacgcagcccaaaucgacuucgacaaaagauucggcaaauucaaagcugaaacugaacccaagcucccauauaacaacgagggauuuaucuucaaaaacagcuucgaggaaaugcugucugacuucaagaucucgcaaccggaacuccuaagcggcaacaagaaggucccauaugauuggacaaucuacuaccuacggaaaaaggcuguuucccaaaagauagaaaaggaggaacuagcauggauccuacucaauuuuaaccagaaacgcggcuacuaucagcuucguggagaggacuucgacgaggaaaaggacaaaacuuucgucacccuaaacguagacaagguaaucgacuccggugaaaaagucaagggaaauauacuguucgacaucuacuucacgaacggauggaaauacgaaaaacaaaccacgaaaccagaagacugguuaggacgcucgaaagaguucauuauaacggaaucgcuucucaaaaauggggaggugcggcgcaccuucaaagcugucgauuccgaaaaagacuggaucgcgauuaaggccaagacagaacaagagaucgagaccgcccauaaaacgguaggaagcuacauuuacgacgccauccuccaaaaucccaaacagaaaaucaaaggaaaacucguacguaccauugaaagaaaauuuuacaaggaagaauuacgcaagauccuagaaaagcagaaagacuuccaccuugaauuacaaaacgaagauuuauacucggacugcguccgcgagcucuaccgaaacaacgacacacaccagcucagccucgccaagaaaucauucauacaccuauuccucgaggacaucauauucuaccagcgaccucuaaaaucacagaaaagcucuguauccaacugcacccuggagugucggaaauaccgggauaaaaacggcgcagaagguauccaauuccucaaggucaucccgaaaucaaacccauacuaccaagaguuccgaauuuggcaauggaugucgaaccucaagauauaccggcgugaugacgacguaaacaucacgagcgaaugccucaaaacggcggaagauuacgaagaccuguucguguucuugaauaucagaaaggaagucgaucaaaaagccugccugcgccacuucaaacucagcgagaaaacccaccgcuggaacuacguagaagacaagaaauauccgugcaacgaaacgggcaccaugauaucagaacgccucaagaaggucggggacuccccugacaacaucuucacccgggaaauggaacaacaaaucuggcacauaauauacuccgucaacgacaaaaccgaguacgaaaaagcccucaaauccuucgccaagaaaaacgagcucgacaacgacuccuucuucgaggcuuuccggaaauuuccucccuucgacucagaauacggcuccuucagcgaaaaagccauaaagaaacuccucccauugaugagaaucggaaaacacuggaacugggaagcggucgacgagaaaaucaaaaaucgaauccaaaagauaaucaucggcgaauacgacgaaaacaucaaagacaacauaagagaaaagacccucagccuacaaaaagaauccgacuuccaagggcuaccgcuguggcuggcacaauacguggucuacgggcggcacagcgaggcuucgguagccggaaaauggaacagcguagacgacaucgaagaguaccugaaagaguucaaacaacacucacugcguaacccaaucgucgaacaagucaucauggaaaccgugcgcguugucaaagauaucuggauaaaguacgggaacggagccgcggacuucuucgacgagauacacaucgagcucggccgcgagaugaagcucccagccaaggagcgaaacaagaugacccagaaaauuuccgaaaacgaaaacacuaaccugagaaucaaagcacuucuggccgaaaugaugaacgacucggagguccaaaacguacgucccuacucacccaugcaacaggaaauacugaaaaucuacgaggacggcgcgcucaacucggagauaucgguggacgacgacauacuaaaaaucucaaaaaccgcacagccaagcccguccgaccucaagaaguacaaacuuuggcuggagcaaaaauaccgcucaccguauacaggcgacaucauaccccucaauaaacuguucaccaccgaauaugaaauagagcacauaaucccacaaucacgauauuucgaugacuccuuuuccaacaaagucaucugcgagucccuugucaaccggcucaaagacaauuacauaggccuaggcuucaucaaacaauuucacggcuacaagaucucagacaaaacaaaaguauucgaagucgaggaauacgaagauuucgucaagaaaaacuaugccaacaaccggucgaaacggucaaagcuacuccuagaagaaauucccgaagagaugaucgaaagacaacuaaacgacacaagauacauauccaaauacaucagugggauacuauccaacauugugagaaagaaggaaaacgacgagggcguaaacucaaaggacaucauaccaggcaacggcaagauaacgagccaacuaaagcaagauuggggacugaacgacguguggaacgaccugauccucccacgguucgaaagaaugaacgagcucaccaaaagcaguuacuucaccgucuggaacgagaaauaccagaaguuccucccaaccguaccgguagaauuuaguaagggguucagcaagaaacgcaucgaccaccgacaccacgcacuagaugcacucgugaucgccugcgcgacgaaagaccacgucaaccuccugaacaacaaaagugcaaaguccgaaaugaaaagauacgaccucaaacggaagcugaugaaguucgagaaaaagacguaccagcacagccaaacgggcgaaagaauaguaaaggacguccccguagaguuccugaaaccauggaacgacuucacgguggaagcgaaagaaaaccuagaaaagaucauagucuccuuuaaacaaaaccuacgcguaaucaacaaagcgaccaaccauuaugaaaaguggaucgaaaaagacaaugucaaagucaaaggccucguagagcaacaagggcuaaacugggcaauccgcaaaccccuccacaaggauacagucagcggaaaaguagaccucccggguaucaaagugcccaagggaaaaauccucaccgcaacacgaaagagcauagacacaucauucgaccucaaaaccaucaacuccauaacggacacggguguacagaaaauccucaaaaauuaccuugaauacaagggcaacucgagcgaggaagccuucuccagcgagggaauagaggacaugaauaauaacauagaaaaauucaacgagggaaagcuccaucaacccauaacgaaaguacgcauauucgaacucggcucaaaauucccacuaggccaaauagggaauaaaaagcacaaauacguggagaccgcgaaaggaacaaaccucuucuucgccaucuacgaggacgacaaggguaagagaacguaugaaaccaucccacucaacgaagucaucgaacgucagaaacagggccuugccccagugacacuaaagucgaaaaacgacuucuaucucugcccaaaugaccuaguguacguagcggcugagggcgagaguguaaauaaaauagauuucaaguacgccagucaagaauuuauacacaauaucuacaaagucgucucguucuccggaagccagauauucuucgucaaacaaaauauugcaguaucuaucgucaacaaggccgaguucucuacgcucaacaaaauggaacgagcggucgauggaaagaugaucaaagacuguugcauaaagcucaaaaucgaccggaucggaaacaucaccaagagcuga

SEQ ID NO: 6791 - RNA, 4239 nt, Artificial Sequence
  Cas9 variant
augaugacgaagaacauacucggccucgaccucggaaccaacucgauuggcugggcccuaauaaaacagaacgcggaggaacgaaagggaucgauacucggcaugggcacccggguauuaccaaugagccaagacgcgcucggggacuuuggaaaagguaacucagugagccagaccgcagccaggacgggcuaccguggggugcgacgccugcgcgaacgguuccuccucaggcgcgaacgccuacacagagugcucaacauacugggcuuccugcccgacuacuacgccgcccaaauugacuucgacaagcgcuucggcaaauucaaagccgagaccgaaccaaagcuaccauacaacaacgaaggauucaucuucaaaaauagcuucgaggaaaugcucucggacuucaaaaucucgcaaccagaacugcugagugagaacaagaaaaucccauacgacuggacgaucuacuaccuccgcaagaaagccguaucacaacgaauagagaaagaggaauuaguguggauacuccuuaacuuuaaccagaaacguggcuauuaccaauuacggggcgaagacuucgaugaagagaaagacaaaaccuucguaacccugaacgucgacaaaguaauagacaguggcgaaaaagucaaagggaucguccuguucgacgucuacuucacuaacggguggaaauacgaaaaacaaauaaccaaaccagaagacuggcuugggcgauccaaagaguucaucaucacagagucccuccucaagaacggggaaguaaagcggacauucaaagccguagacagcgagaaagacuggaucgcuauaaaagccaagacagaacaagaaauagaaaucgcucacaaaaccguuggcucguacaucuaugacgccauacuacaaaacccgaagcaaaagauaaaaggcaaauugauccgcacgauagagcgaaaauucuacaaagaagaguuacgcaagauacucgaaaaacaaaaagaguuccacccagaacuucaaaaugaagaucucuacagugacugcguucgggaacucuauagaaacaaugacgcccaccaacucucacuugcuaagaaagacuucauccaccucuucguggaggacaucauauucuaccaacgcccgcuaaagagccaaaaauccuccguuuccaacugcacacuagaaugucgcaaauauaaagacaagaacggagaggaacgcauacaguuccuuaaagucauccccaagucaaacccguacuaucaagaguuccgcauuuggcaguggaugagcaaccugaaaaucuacaggcgagacgacgacgugaacauaaccucugaauaccuaaagacuacagaggacuaccaagauuuguucgucuuccucaauacgcgaaaagagguugaccagaaagcaugccuaaaacacuucaaguuaaacgagaaaacucacagauggaacuacguggaggacaaacgguacccaugcaacgagacgggaaccaugauacuggaaagauucaaaaaggucggagacucggcagacaacaucuucacccgagaaauggagcaacaaauguggcacaucaucuacagcgucaacgacaaaacagaguacgaaaaagcgcucaaauccuucgccaaaaagaacgaccucgacaacguuagcuucuucgaagccuucaggaaguucccgccauucgacucggaauauggcucuuucagcgagaaggcaaucaagaaacugcuaccccucauacgaaccggcaaauacuggaacugggaggcaguggacgagaaaacaaagaaaagaauacagaaaaugauaacaggagaaugggacgaagauauaaaagauaacauacgcgagaaaacccuaucgcuccaaaaagaaucggacuuccaaggccucccucuguggcuggcccaguacgccguauacggcaggcauagcgaggcguccgucgcaggcaaauggaacuccgucaaugacauggaagaauaccuaaaagaguucaaacaacacucgcugcgcaacccaaucguagaacaggucauaacugaaaccauccgcguggucaaagacauauggauuaaauauggcaacggugcagcggacuucuuuaacgagauccacaucgaauuaggccgagaaaugaaacugccagcaaaagaacgaagcaagaugacccaaaagauuuccgaaaacgagaacaccaaccugcgaaucaaagcccugcucguggaaaugaugaaugauagcgaagugcacaacgugcgaccguacucuccaaugcagcaagagauccugaaaauauacgaagacggugcacucaacucagaaaucucaguggacgacgacauccucaagaucucuaaaaccgcacaaccgagcccgagcgacuuaaagaaauauaagcucuggcuggaacaaaaauacagaucgccguacacuggagacaucaucccucuaaauaaacucuucaccaccgaguaugaaaucgaacacaucauaccgcagucacgauacuucgacgacucguucagcaacaaaguaaucugcgagucgucaguaaaccgccuuaaggacaauuacaucggccuaggauucauaaaacaguuccacggcuacaaaaucagcgauaagacgaaaguauucgagguagaggaauacgaagacuucguuaaaaagaacuacgccucaaacuggagcaagcgcagcaaacuauuacucgaagaaauaccggaagagaugaucgagcgucaauuaaacgacaccagauacauaagcaaguacauaagcgggauacucucaaauauagucaggaaaaaggagaaugacgacggcgugaacagcaaagacaucaucccaggcaacggcaagauaaccucccaacucaaacaagacuggggucucaaugacgucuggaacgaucucgugcucccccgauucgagaggaugaacgaauuaacgaaauccaacgacuucaccgucuggaacgaaaaguaucaaaaguuccucccgacagugccaguggaguucucuaagggcuuuuccaagaaacgaauugaccauaggcaccacgcccucgacgcccuagucauagcgugcgccacacgggaucauguuaaccugcuaaauaaccagucagcccgcagcgaaaugaaaagauacgaccucaaacggaaacugaugaaguucgaaaagaaagccuaccagcacucacaaacaggcgagcgcaucgucaaagaugucccggucgaguuccuaaagccgugggacaauuucaucguugaagcgaaggaaaaccuagaucgcauaauugucucguucaagcagaaccuccgcgucaucaacaaagcgacuaaccacuacgagaaauggaucgagaaaaacaacguuaaaguaaaagcccucguggaacagcaaggacuaaacugggccauacggaagccccuccacaaagacacggugaguggcaaagucgaccuacccgggacaaaggugcccaagggcaagauccucaccgccacacgcaagagcaucgacacuagcuucgauaugaaaacaauaaacagcaucacggacacgggcauacaaaagauccucaaaaacuaccuggaguacaaaggcagcuaugaagacgcauucaguccagagggaauugaagacaugaacaaaaacaucgaaaaguucaacgacggaaaacaacaccaacccaucaucaaagucaggaucuucgaacucggauccaaguuuccgcugggccagaucggaaacaagaaacacaaauacguagagacagccaaaggcacaaaccuauucuucgcuaucuacgaagacgacaaaggcaaaaggacuuacgagacaaucccucuaaacgaagucauagaacgccaaaaacaaggccuggccccggucaccuuuaaaagcaaaaacgacuucuaccucagcccaaacgaucuagucuacguagccgcagaaggggaaucggucgacaaccucgacuuccaauccgauucccaagaauacaucaacaacguauacaaagucgucagcuucucagggagucaaaucuucuucguuaagcagaacgucgcugucuccauagucaacaaagcggaguucagcacccuuaacaagauggaacgcgcgauugacggccgaaugauaaaggaguguugcgucaaacugaaaauagaccgcaucggaaacaugaccaaaucuuga

SEQ ID NO: 6792 - RNA, 4245 nt, Artificial Sequence
  Cas9 variant
augaagaaaauacucgggcucgacuuagggacaaacagcaucggaugggcauucguagaggaggcagaaaacgaaagugaaaaauccuccaucaucaaacuuggcguuagagucaacccuuugacagucgacgaacaacaaaacuucgagaaagguaaaagcaucacaacaaacgcggaccgcacccuaaaacgcagcaugcgacgcaaucuccagcgcuacaagcaacgacgggagaaccuaauagacauccucaugaaaaacgguuucacguccgacgacacaauacuuuccgagaacgggaaccgcacaacguucgaaacuuaccgucuccgauccaaagccguagcugagaaaaucucccuccaagaauuugcgcgcgucuuacugaugaucaacaagaagcgcggcuacaagaguagccgaaaagccaagggaacagaggauggcgagcuaauagacgggauggaaguggccaagaaacucuacaauuacaaucucaccccgggacaacucugccugcaacuccugaaugaaggcaagaaacauuuaccagacuucuacagaucagaucuccaagcagaauuugaccgaauauucgauauccagaugacguucuauacagaguaccucacccucgagcucaaagaggaacugcguggaaagaaacgcgacgccgugugggccauuugcgccaaaauauucaaagaaaaaggcuuugaacucaucgggaccaaacgccaaggaaguacggcagaacaaaaacaugagaacuacucauggcgggccaaaggccuauccgaaaaacucgagcuagaacagcuagucguaguccuccaacagauaaacauccagcucaacucauccucaggcuaccuuggcgcuaucagcgaccgaaguaaagaacucuuuuucaacaaacaaaccgucggccaauaccaaauggcuguccucgacaaaaacccaaacgcgggccuacggaacaugguguuuuaccgccaagacuaccuagaugaguucaacgcaaucugggaaaagcaggcccucuuccacccaauccucacggauacucugaaggacgaaaucagagacgucaucaucuucuaccaacgucgucucaaaucgcaaaaaggccuaauauccuucugcgaacucgaaucacgcaaaaucgagguggagaucgcgggacaaaacaaaaccaaaauggugggcagccgaguaaucccucguuccagcccccuauuccaagaguucaaaauauggcagucccuaaacaacaucgaagucuucggaaaagggaaaaagagcaagaagcaaaaagaacagacacuguucgaccagaccgaagauccacucgaauuuggaggucgacgcgaacuauaugaagaagagaaagaacuacucgcccuagaacucuccaucaagaaagagcucaagaaagccgacauacucaaacuacucuucgacaaccccaaagagcucgaucucaacuuuaacgcgguccaggggaaccuaacccaggcuacacucuucaacgucuacaagaaaaucaucgagcucagcggucacgaaaucgacguggagaaagacucugcaagcaaaauacuuaaaucuaucgaagagaucuucaaggcgcuuaacuacaacaccgaaauacuccauuucgacagugaaaaaucucaagaccaacaggcuauguacaugcuauggcaccuccucuacucauuugagggagauaacagcaacaccggcaacgaaaaucuaaucaacaaaauaucuaaacuauacggcuucgaaaaggaguacgccaaaauccucgccaacguaucauuccaggacgauuaugguagccucucggcaaaagccaucucgaagauacucccguaccucaaagagggacauaaaagcgacauagccugcgaccucgcgggcuacaaacacagcgcuuccucgcucacucgagaggaacucgagaacaagacguacaaagacagacucgagauccuaccgaaaaacacacuccggaacccagucguugagaaaauccucaaccaaaugauuaacgucauaaaccucaucaucgacagccgagaacucaagaaaagcgccaaagaacgcgaagaacuaacaaaauccauaagcgaaaccacaaaacuccaccagcaauacaaagacauccucgcaaaggccccauuuaaccuuacaaacaccucccguaacgauaucauacgcuacaaauuauacgaggaacucaaagacaacggcuauaaaacgcucuacucaaacaaguacauaucccccgcagcacuuuucagcggcgauuucgacauagaacauaucaucccacaaucacgccuauuugacgacucauucucgaacaaaacgcucgagcuccguucaaucaacauagaaaaggggaacaagaccgcauacgacuucaucaaagggaaauacggggaaaccggcgaagauaacugucuggacaaguaccucaacagaaucgaaacccuguacaagaacggaauacuuaaaaaguccaaauacaacaaacuaaaaaugcaagacaaggauaucccagacggcuucaucgagagagauauccgcgacacacaguacaucgccaaauacgcaaaaacacuccuaggggaccucgucaaauucgucgucagcacaucagguuccgucacggaacgccuacgagaagacuggcagcuagucgauguaaugaaggaacucaacugggaaaaguauaugcaacucgggcuaacugaggaguucaccaaugaagagggacaccgaauccggaagauuaaggacuggaccaaacgcaacgaucaccgacaccacgcaauggacgccuuaacggucgcguuuacaaaacgccaauuuauccaauaccuaaacaaccuuaacgcaaggagaaucucagacgaacaaggcaucucuaacucugagaaggacgaacgcaacaacgucagcauuaccacgaacgacaugaagcuaaauacccgagacguccuggguaucgaaaagaaagaacucuaccgcgacaacagaggcaaacuacguuucaaggcaccaaugccacuccuggaguuccgagaagaagcuaagagacaucucgaaaacacacuaauaucaaucaaagcgaaaaacaaagucacaacgaucaacauuaacacgcucaaaaaggcaggagguguuuacaagaagacucaacucacaccgcgggggcaacuccacaaugaaaccaucuacggcucacagaaacaauacaucgucaaggaagagaccauaaacgcuaaguucgaugucgagaaaauagcaaccgucacaaaccccgucuaccgcgaagcucuccugaaaaggcuugaacaaaacaacaacgaucccaagaaagccuuuacagggagcaacgcgcucaccaagaaaccaaugugguucgacgagcaacagaccgaaaaaguaccagagaaagucaaaacuguaucauucgagacaaucuauaccauccgaaaggaaaucagccccgaccuuaaaauugaaaaagucguggacgaaaagguacgacaaauccucaacaacagacucaacgaauacaauggcaaugcuaagcaggcauucuccaaucuagacgaaaacccuauauggcuaaacaaggagaaaggcauaacaauuaagcgaguaaccauaacugggauaaacaaugcccaggcgcuccacgaaaaacuggacaaagacgggaaaccaauccucgacggcgagggaaagaaacaaccggucgacuucgucaacacuggaaacaaccaucacguagccgucuacugcgacgcagacgguaaucuccaggaaaacgucauuucauucuacgaagccguaacccgccgcaaccugggacuucccaucauugacaaagacuacaagaaagaugacggcuggcaguuccucuucagcaugaaacaaaacgaguauuucguguuccccaacgaaagcacaggguucaaccccaacgaaguagauuuacuaaacccggauaacuauagccucauaagcccgaaccucuuccgaguacaaaaauucaccauuaaggacuacuucuuccgccaucaccucgagacgaacgucgaaucgaacucaacccuuaaaggaaucaccuggcugcgcugcggacuaaacaacauagacaacaucaucaaaguccguauaaaccacaucggccaaaucauacacguaggcgaguacuga

SEQ ID NO: 6793 - RNA, 4248 nt, Artificial Sequence
  Cas9 variant
auggcgaaauuuaacaaacccuacagcaucgggcuagacaucggcgucuccucagucggguacgccguaaucacggaggacuaccgcguccccgccuuccgcuucaaaguccuuggaaauacagagaaagagaaaauaaagaaaaaccuaauagguuccaccaccuuuguccccgcccagagcgcacaagucacccgcguauucagagugaaccgccgccgcauugacaggcgcaaccaccguaucgcguacuuacgcgauaucuuccagaaagagaucgagaaagucgacaaaaacuucuaccgcagacuggacgagucguuccgagucuugggcgacaagucugaggaccugcaaaucaaacaacccuucuucggggacaaagaacuagaaacggccuaccacaagaaauacccaacaaucuaucaccuucggaaacaccuagccgacgcagacaaaaacuccccggucgcggauauacgcgaaguauacauggcgcuuucccacauacuuaaauauagaggccacuuccucacccucgacaagauaaacccaaacaacaucaacaugcaaaacucauggauaaacuucaucgagucgugccaagaagucuucgaccucgaaguauccgaggagagcaaaaccaucgcggccaucuucaaauccucggaaaacagacaagagaaggucaaacaaaucuuguccuacuuucaacaagaacuacuaaagaaagacaaauccauauucaaacagcuccugcaacuacucuucggccucaaaacgaaauucaaagauugcuucgaacuugaggaggaacccgacuuaaauuucucuaaagaaaauuacgacgagaaccucgagaaccuacucggcacacucgaggaggacuucuccgacgucuuugccaaacugaaaauacuccgagacacgauccugcuaucagauaugcuaaccuacacuggcgccacacacgcaagauucuccgccaccauggucgagcgguacgaggaacaucgcaaagaccuacaacguuucaaaucuuucguaaagcagaacuuaucggaacaggacuacuuggacaucuucggacguaaaaccccaaacggcuucgacguugacaaagagacaaagggcuacgugggcuauauaagcaacaagaugguauuaacaaauaaacaaaagaccauccaacaaaacuuuuacgacuacaucuccggaaagaucaccggaauagaaggagcugaauacuuccucaacaagauuucggauggaaccuuccuccgcaaacuacgcaccacagauaacggggccauacccaaccagauccacgcuuacgaacuugagaaaauaaucgaaaggcaaggacgggacuauccauuccuacuagaaaacaaagacaagcucuugucaauucuuaccuucaagauccccuacuacgucggaccccucgcaaagggcaacaacucgcgcuucgcuuggaucaaacgcgccacaagccaggacauacuugacgacaacgacgaagauacucguaacggaaaaauccgacccuggaacuaucacaaacuuauaaacauggacaagacgcgggacgcuuucaucacgaaccugauaggaaacgacaucauuuuacuaaaugaaaagguccugccgaaacggagccuaaucuacgaagaagucaugcuccaaaacgaauuaacccgagucaaguacaaggacaaguacggcaagacacacuucuucgacagugaacuccgccaagaaaucauaaacaaccucuucaaaaccaacucaaagcgagucagcucggcaaugcuacucaacuaccuagaaaacuacaccaaccuacaggccguugaaauagugucuggaaucgagaaaggaaagucccucaacuccacucugaaaaccuauaaugaccucaaaaccauuuucucagaggaacuucucgacuccgaaaucuaucaaaaagagcucgaggaaauagugaaagucauaacaguauucgacgacaaaaagagcauaaagaacuaucuaaccaaauauuucggacgccucgaguuccucaacgaagaaaggaucaaccaacucagcaaacuccgguacacaggcuggggcagguauagcgcaaaacuccuccuagacaucagggacgaagacaccggauucaaccucaugcaauuccuccgaaacgacgacgagaacaggaacuugucacaacugauauccgacucaacacucucauucgacagcgccauuaagucgauacaaucaaagagcacgguggaagacgacguauucgacgaaauaaagaaacuagcggggucccccgccaucaaacgcgguauccuuaacagcauaaaaauuguugacgaacugguacaaauaaucggguaucccccgcaaaacaucguaaucgaaauggcaagagagaacaugacaacagaagaaggccagaagaaagccaaaacgcguaaaacaaaacuagaaagcgcccucaaaaacaucgaaaacaguguguuagagaacggcaaaguaccccacagcgacgagcaacuccaguccgaaaaacucuaccucuacuaccuccaaaacggcaaagauauguacuccuuggauaaaaccgggucaccaacaccacuguaccgugaucggcuagaccaauacgaagucgaccacaucauccccuacagcuuccuaccaauagacucaauagauaacaaaguacuuacccaccgugaaaacaaccagcgcaaacuuaacaacauccccgacaaagaaaccguggccaacaugaaacccuucugggagaaacucuacaacgcaaaacucaucagccagaccaaauaccaacgacucacuacaucugagcguacgcccgacggagugcucacagaaucgaugaaagccggauucaucgaaaggcagcuagucgagacccgacaaaucauaaaacacgucgcacgcauccuggacaaucgauuccuugacaccaaaaucauuacacucaaaucacaacucaucacgaacuuccggaacacauuccacaucgccaagauaagagaacucaaugacuaccaccacgcccaugacgccuaccuagcugucgucauaggccaaacccuacugaaagcguaccccaaauuagcccccgaacuaaucuacggccaccacgcucacuucaaccggcacgaagagaacaaagcgaccauucgcaagcaccucuacuccaacauaaugcgcuucuucaauaacccaaacucaaaaguaucgaaagacaucuggaacugcaaccgcgaccuccccaucauaaaagacaucauauauaacucccaggucaacuuugugaaaaggaccaugaucaagaaaggcgccuucuacaaacaaaacauaauacccaaugauucgucgguuacagucgacaaacgguucccgaucaaaaacaagaaauaccuggaccccaaacuauacggaggcuacuacgaacgaaacucagcccucagcguauucauaauagggcaguccuuuaacaaaaacaacaaacuaaaagugguaaaagaguucuacgauaucaacaucaucgacuacccccucuucaacaccgacccgaugagcuucuucaacgacgacucugaaaacggcuuccucacuaaaaacaaccuacaauccguacaagcguucuacaaaauccccaaauacucccuaauccagaaaaacgacggcacaagaaugcuauucgaaagcacaacaaacuuccacaaagccacacaauuuaaacucaccgaggcucagaacgaacucuucuuccacaugaaacgucuauuaacgaaaaccgacuucauggaccugaaaagcgaagaauccaucaaagagagucaagacuucaucaugaaucauaagaaugaguucgacaauauagucaauggacucuucggguacgcagaacgccaacuagggagcaaaucccucuucacacaagcacacgaggcuuacaaacuacgcaaauaccccguguucagccucaacgaggagacgauacgauacuauuacgauaauuuccuucgacucuucucccucaccaaaucaggcacuagcucgggcuacguuguaggucuauucgaagccccaaaacucagaaacguaguguaccgggcaaccaaagaugagagcaacgcgacacucauccaucaauccaucaccggccucuacgagacucgaaucgaccugaguaagcuaggcgaggauuga

SEQ ID NO: 6794 - RNA, 4248 nt, Artificial Sequence
  Cas9 variant
augaaccugcgcaacguugccaaagagggaauaaacuauaauaucggccuggaccuagggacagguucggugggaugggcugugacagacgagcagggcgaacuauucucguucaaagguaaaacuaccuggggaagcaggauauucccaaccgcugaaaccgcagcagacaccagacucaagcgcggccagcgacggcgauacgccaggcgcagauggagacuagaccuccuacagagccuauucgaagaggaaaucaagaaaguagaccccgaguucuucacgagacuaagacaaagccaccuacuaaaggaagacaagacauacgcugccauccuaucaagcaagggcgccacacgcccgcuauuuccugaaggcgaagccgaagucgaauacuacaagaaauaucccacaauauaccaucuccgcaaagcccuaauggaaucgaacaaccaagaagacauccgacuuaucuaccuggccuuccacaacaucguaaaagcacgaggaaacuuccuccaccaagacaccccgggacucacggcaagcaaugcaaacaugggcgacgccguagaaaagcucugcucugcgcuagaagacuggugcucaagccaaaacauagaaugcgcgaucaggaaaaaccagaaaagcauucaagaccuaauggaaggcaaaaccaucgaacccagcgagucaaacgcacugaaagagacguucgacgcaagcagaucuucgaggaaagauaaagccagcgugcuagcaggauggauugccauacaaccaggagagcaauuugaacccaaacaggcaaaagaugcaucaaaagagaucgcaaacgcugucuucggccucagugcgaacaugaagaaaguauuuguagagcucgaggaggaccagaaaaucuaccuaaacaacgaugagcaagucgaggccuucuauacggugugccccgacgaaggagucgcgcuguucgaagcacugcagagcauguacuccgcguacgugcugaugggcauauuaaaaggagcggacggcggaucuaucagcagcuguaagguagcggccuacgaacaauacaaagaggaccucaaacuacucaagacgcugguccgcgaguucgcgcccaagaaauacgacgaguucuucagaggcgacauauucgaugcgaaaaagggcuuccggacgagaaacuacgaccccgccacggcaaagggauauaccaaauacaauagcguaagaggggccucauacgacgcauucaaaaaggaaguggaaaaauuauucgagggcaccgccgcugaagaagacguccgauacacggacaugaugcaacgauucgacgaaggaaccuuccuccgcagacuaaagaccagcgacaacggcagcaucccauaucaacugcaccuagaggagaugguugcgaucauagaaaaccaaaagacauuuuaccccuuccucgaagaaaacaaagagaaauucgaaucgcuaguaacauuucgcauccccuacuacgugggcccacucacccagaaaaacgcuagacccgacaaccacggcaacgccagauucgccuggagccaacgcaaagagggacaagaaaacgcgcgcguauacccguggaauugggaggagguaaucgaccgcaaacaaagcgccgccaaguucauggagcgccuaacgggcacaugcacauacauacuagaggaaccaguacugccgcguuauucccuccucuacgaggaauacugccuccucaacgaacugaauggggcccgauggcgggacaugggcggugauuggcacagguucgacuacgaaacccgcauggauauaauagaggaccucuucaaaaagaagaaagguaccguaaaauacgcaacagucgcagacuggcucguacgcgagaaacaccgauccugcgccgaggugaaagggggacaaggagagacaggauucgaaucgaaacucucgagcuacgucuucuucaagggcguccugcauguggaugagauagacgaagcagacaucccgaugaucgaagaacucauaugguggaacacucucuucgaagacagauccauacucaaagagucaaucgaggacaaauacggagaccggcucaaugaugagcaaaucaaagccauauguaagaaacgauucacugggugggggcggcuaagcaaaaagcuacuaugcggcaucaaagcgcagacagacaacggcccuugcagcauaauggacguacugcgcgaaggaaacccaaacaacgacgcaagaagcgccacaaugguauucauggagaucaucagagaugacaaauucggauucacaaaacuaaucgaagaagaaaacaagaagaggaucagcagcguggacgacuucgacgucaacgaucuuccgggaagcccagccguaaggaggaccguaaaccaggccaaaaggaucgucgacgagaucgucggcaucgcaggcugugcgccucagaacauauucauagaagucacaagagaugaggacggaagaaacaaaggaagacgcacgaaaagaagauacgacgccauacaagaggcaguaaagguauugaagaaagaacagaaggaguacuuugaugccaacguagcugaccuccucaaaaacacagccccagcagcgcucgacgacgaaaggcucgcacuguacuucaugcaaaacggaaaaugcauguacugcggaaaggaccuggacaucaaccagcucgacaaauaccagguugaccacauccucccccagaguuacgucaaagacgacuccuucgagaacaaagcccucguccacucggacgacaaucaacgcaagagcaacagcaugcuacucgacgauagcaucauuagaaaaaugaaaccauacugggaagcccugcgaagcgccgguuugauuggugagaaaaaguucaagaaccuaacccgagugcgugucucugacaaagaacuaggcggguucaucgccaggcaaauggucgaaacgucccaaaguaugaaacugaccucucuccuccuagaacaagccuaccccgaaacgcagguccgcccuguaaaagccggcuucagcuccgaucugagacgccgacucaagcuggugaagugcagagaaauaaacgacuaccaccaugcucacgacgcguaccuugccugcgagguaggccaguucauagcacucagacacaacaagcuguacgaaaacccgauaggguacagucacgcaguaaaagacuucaucgcaaaaagagcgaaauacgccagcgagcaugguaaacccauggauaccuacggaaugcccggaagcuccagcuucgucaucagcagcuucaugaccagcggcuucgacgaggagacuggagaaauauucaaagaugcgugggacgcaagccucgcggccguccggauccaccaagcgcucaaccgaaaagauuguuauaucuccagaaugcccgaagaaaccuccggagcguucugggacgcaacaauauacagcccaaaacaaaccaaaaagaaacucucgcugccucucaaaaagggucuggacccgcaaaaguauggguccuacucacgggaacaguucgccuacuucuucguguacgaggcgaagaaaaucaaaaagaaagaagagacaaaggaauauguguuugcgucugugcccguccaagucgcggcgcuagucgcagcagaccccaacgcacuaauagaguucgccaaagccgacgccgaagaaagaggacugaaauucgccaaaaucguccgagaaaaagucuacaaguaccaacucaucgaaguaaacgaugaaagauuuuucguuaccggcuugcgaacaguacgcaacggccuccaaaucgccuuuagcgaacaagaucggaauaucgugagcggaaucguagaaggcaacagcucaaacaacaaccuccuagauaucuacgacaaaauuacaaaucgauacgcacucuacgcauccagauucggcaagcuguuaaaccucucgggcuacagggagaacuuuauccaggcgagccuggaggaccaagaaagagucgugcucgcccuaaucagucucuucaacgcacggaccaacaugauagaucucucggcaauaggcagcagcaaaacggugggcaacaugucuaugacauuugcgaaagaaauggcaauggcagacaaccgauucgccuucauagaccagucgguaaccggcaugcuugaacgaaagacauaccuauga

SEQ ID NO: 6795 - RNA, 4251 nt, Artificial Sequence
  Cas9 variant
augggaucacgcaucauacccaugagccaagacauacucggugaguucgguaaagggaauagcgucucucaaacaucagaacguacagcguaccggagcacccgccggcugcgcgaacgguuccuccuccgacgagaacgccuucaccgcgugcuaaacauccucgacuuccugccaacucacuacgcgagccaaaucgacuucaagaaacgacuuggcaaguucaaagaaaauaaagaacccaagauagcguaugacaacaagucauuccuauuccucgauagcuucaacgaaaugcuuaaggacuucgagcaagagcaaccaaacaugcucaucaacgagaaaggagagaagaaacuaaucccauacgacuggacccuauacuaccuucgcaagaaagcgcucagagagaaaaucuccaaagaagaacucaguuggauaauccucaacuucaaccaaaaacguggcuacuaccaacuccggggagaagacgaagaggagaaccccucaaaacuggucgaguuccacucacucacagucgucgacguggucccagacgagcccauaaaaggcaaacucgaaacaugguacucuaucauccucgacaacggcugggucuacaggcgcagcucgaagacugagcucuacgacuggaaggacaaaaucaaagaguucaucgugacgacggaccuaaacuacgauggcacaguuaagacagacaaggaaggcaacguaaaacgaucguuccgcgcgccuuccgagacggauuggacacuaauaaagaagaaaacagaauacgaaauagaacaguccagcaaaacaauuggcgaguacaucuauaauacgcuccucaaauaccccgaacaaaagauacgcggcaaacuaauccggaccauagaaagaaaguacuacaaggaggaacugaaacagauccuccucaaacaaacagaguuccauaaugaacuaaaagacgacagccuauacuacgacugcuugcgcgaacucuaccgaaacaacgaaagccaccaacuauuccuggaaaagaaaaacuucgcacaauuauucaucgaagauauaaucuucuaccagaggccccuccgaagccagaaaucccucauuuccaacugcccccucgaguucuacaaauuuaaagacucagucggcaaugagaaaguacaacaccucaaagcuauaccgaaaagcaacccuuucuaccaagaguuucgcaucuggcaguggauauccaaucucuccaucuacagcaaacucgacgauagcaauuucacaagccacuucuucgacuccaccgacgacugggagagccuuuucgaaaugcuuaauggacgaaaagagauagagcagaagcaacuccuaaaauuucuacuggagaaaaagggguucaaggggaaaagccucagcagcgaaaucgagaaauaucgcuggaacuauguagaagacaaaaaguaccccugcaacgaaacucggucccugauccagucacgacuagacaaagucgccaaucuaccagaauccuuccuuacacgccauguagaacaggaacuauggcaccucaucuacucgguaacugacaagaucgaguucgaaaaggcccuggacacguucucuaagaaauacaagaucgacacaccgaccuuuguggacgcauucaaaaagugcccucccuucaagagcgaguacgggaguuucucagaaaaggccaucaagaaacugcucccccucaugcgcacgggaaaauacugggaccuugacaacaucgacaaagcuaccaaacaacgcaucgagaaaauuaucuccggcgaauacgauaaagacauaagggaccgcguacgugaaaaagccauuaaccuacuaagcgaaaccgacuuuaaccgucugcagcucuggcucgcccaauacauaguauacgacagacacucagaagccaccagucuggauaagugggagaccaucgacgacauuguaaccuaucugcacuccuucaagcaacacagccuaagaaaccccaucguagagcaagucauaaccgaaaccauccgggucgucaaagacaucuggucaaacuacggaaacggcucgaaggauuacuucaacgaaauccacgucgaguuaggacgagagaugaaacuccccgcugaggaacgcaaaaggauccaagagaaaaacagccaaaacgaagacacgaaccuccgaauaaaggcccuccucagcgaaaugcaaaacgacccgaauguggagaacguacgcccauacucccccguccaacaagaaauccugaaaauuuaugaagagggcguacugaacuccaacauugaaaucgccgacgacauucucaagaucagcaaaaccgcccagccaagcagcagcgacuuaaagagguacaagcucuggcucgagcaaaaauaucaaagcccauacacaggcgaaauaauuccccucaacaaacucuucacaccugaauacgaaauugaacacauaaucccucaaucacgcuacuucgacgauucguauaacaauaaagugaucugugaaagcgccgucaacaaacuaaaagacaacuccuuaggguacgaguucaucaaaggauacaacggccaaauaguagaaugcggguuugggaagaaagucaaaauauucucgauugacgaauacgaggacuucguacagaaaaauuacgcgaauaaucgcagcaaggcaucacgccugaugauggccgacauacccgaaaagaugaucgaacgacaacucaacgacacgcgguacaucuccaaauacauaagcaacauccuaagcaacaucguaagaagcgaaucaaacgacgacggcguaaacagcaagaaccucauauccguaaacgguaagaucacaaccguacuuaagaaagauuggggcaugaacgauauauggaacgaccucauccuaccccgcuuuaucaggaugaaccagauaacugauucagacuccuucacaacauggaaugaaagauuccagaaauucaucccaaccguccccaucgagcugucuaagaacuucagcgccaagagaaucgaccaucgccaucacgccauggaugcccuaguaauugccugcgcuacucgggaccacguaaaccuccucaacaaccuguacgccaagucaucagcacgcuacgaccugaaccgaaaacugagaauauucgaaaagacgacauauaaggacaucaagaccggccagauaauagagagagaaauaccaaaagcauuccuaaagccauggcaaaacuucacaaccgacgcaaaggacgccauagagaguauaaucguauccuacaagcaaucacucagaguaauaaacaagaguaccaacuacuaccaaaaaugggucgagaaggacgggauagucaaaaaggagaaaauaaaacaagaaggaaagaauugggcgauccgaaaaccucuccacaaggacacgguauccggccuaguccaacuguccugggucaaagugccaaagggaaaagucaugacagccacacguaaaucccucgacagcuccuucgaccuaaagaccaucgcgacgauaaccgauacaggcauccagaaaauccucaucaaauaucuggaaucgaaaggcaacaacccggaaucagccuucuccccggaagggaucgaagacuucaacaacaacauccaccucuauaacgacggaaagaaacaucggccuaucaccaaagugagacuguacgaaauugggucgaaauuuccccucggcgaaaaaggcaacaagaacgccaaauauguggaagccgcuaaaggcacaaaccuguucuucgcagucuaugcaaauaacaagggcgagcguucguucgaaacaaucccacuaaaccucgucauugaccgauuaaagcucgggcucagcgcagucccagaaaccaacgaaaagggagauaaccuccuuuuccaccuaucccccaacgaccucgucuacgugcccuccgaggacgaaauggagaaccugaagcugaucaaccucgaacacauauccaaggaccaacuaaaccgaaucuacaaaauggucagcucaacguccaaccgcugcuucuuuaucaaaucugaaaucgcuuuauccaucgucaauaaaaucgaauacuccccacucaacaaaauggaaaaauccaucgaagggauaaugaucaaagacguaugccuaaagcuacaggucaaccgcauaggcaaccuagagcgguacuucagcuga

SEQ ID NO: 6796 - RNA, 4257 nt, Artificial Sequence
  Cas9 variant
augaaagucaaaaacauacuaggauuagacaucggcguaacaucgauagguuucgcccacguaacagaaaacgaaaaagacaauaaaagccauauaaagcaacuaggcguacgaaucaacccgcugaccgucgacgaacaaacuaacuucgaaaaaggacgcccagcaucagucaacgccgaccggacacuaaagcgcggagccaggaagaugcuaucccgauauaaagaccggcgcaagaaccucaucgaaauccuauccaaaacuggcuucaucaacagcgaaucgauacuggccgaggacggcaaaaacacaacccauuccacgugggcccucagagccaaggccagccgggaacgcauagagaaagacgagcucgggcgcguucuccuugcuauaaacaagaaacguggguacaaaucgucccgaaaagccaaaaacgaagacgaaggccaggcaauagacggaauggccaucgccaagcgccuauacgaagagaaccucacccccggccaacucguuuaucagcugcuacgggagggcaaaaaguauauccccgauuucuacagauccgaucuccaagacgagcuagacaaaguguggaacuuccaaaagcaauuucaccaagaaauccuuaccgacacguucuacaaagacauacaaggcaaaggacaacgcgcgaccucggccagcuucuacggagucuacggcuucaacacagccgaaaacaaagggucccgcgaagagaaaagacuacaggccuacgccuggcgaagcgacgcgcucacgaaacagcucacucgcgaagaggucgcguucgugauaacagagaucaacaauaaccucaauaacagcaguggcuaucuaggagcaauuuccgacagaagcaaagaacuguucuuuaacaagaaaaccgucgggcaguaccuauacgaacaacuucagcagaacccgcacacaaggcucaaaaaccagguauuuuaccggcaagauuaccuagacgaguucgaaacgauauggaccauccagucccgauacuacccugaacugaccgacgaccuuaaacgcgaaauucgggacguaguaauauucuaccaacguaaacuuaaaagucagaagggcuuaguuucauucugcgaguuagaaagcaaagaaaucaugaucgaaaagaacgggaaagccgcaguaaagaaaauuggcuccaagguagcaccuaaaucaucaccccuauuucaggaguucaaaauuuggcaaguacuccacaacgucgauaucaaaaacaagaaggacaagacaaagcgcccgcuagacgacagcgaaaaagaauaucuauucaacgaacucaacauaaagggcaaccuaaaagcugcaaagguuauacaacuccucacccuaaacaaaaaugaaaccgaacuaaacuacacccaguuggaaggaaauagaacccagaaagcacucuacgaagcauaucuaaaaauacuggauaccgaaggcuacgacguuaauaaccuccucgggaucaagucgaacaaagacgaaguauuccucgacgacuuggacguaaacgcgcuggagauaaaaacgaugaucaagcaaaucuucaacgcccucaauaucaauaccggcauccucgacuuugacgccgagcuagacgggaaagccuucgagcagcaagccucauaccaccuauggcaucugcuauacuccuacgaagaagacggaaguaagagcggcaacgaacaccucuacaaacuccucgaaaacaaguuuggcuucaagccagagcacgcgcgcauccucgcggggauaacccucuccgacgacuacggcaaccuaagcgccaaagcaaugcgcaaaauuuauccccagaucaaagagaacaacuucaguacagccugcgaacucgucggcuaccgccacagcaaaaacagccucacaaaagaagaaaaccaagagagaccacucaaaaacaagcucgaacugcuuaagaaaaacucgcuacgccaaccugucgucgaaaagauucucaaccaaaugauaaacuuagugaaugagcuaauagacaaaaacuccgagaaagacgaacaaggauccauuaucgaauacuuccgcuucgacgagaucagaauagaacuagcccgagaacuuaagaaaaacacagacgagagacgggaccuagacgcugcgauccgagaagguaaccuccgcaacgaaaagauauacaaacucuugcaagcucaauucggcaucaaaaacccaacacgaaacgacaucauacgcuaccgccucuacgaggagcucaaaaacaacggguacaaggaucuauauaccaacagcuacaucccccaggagaagcuauuugggaaagaaaucgauauagaccacaucaucccacaaucaaaacuauucgaugacucguucagcaacaaaacccucacauauaacacaacgaacaaggacaaggguaaccaaaccggauucgacuacaucgagucgaaauauggaauagacggaauagaagcauacaccgcgcgcauagaaaaccucuucgagagcggaaagaaaaacaaagaagagggcguuagcaaagcaaaguaccaaaaguuacugaagaaagagucagaaaucggcgaugguuucauagaaagagaccugcgugaaagccaguacaucgcaaagaaagcuaaagaacuccuccugcagaucacccgguccguaguugcgacauccggcagcauaacagcccggcuacgggaagacugggaccucgugaacgucaugaaggaacucaaccuaccaaaguaccgcgcccucggccuuacagaaauggaggaacguaaauacggccagaaggucgaaguaauaaaggacuggacgaaacgcgacgaccaccgccaccacgcaauggacgcccucaccaucgccuucaccaaacacaaccacauccaguaccuaaaucaccuaaacgcacgcaaggacgaacaacacaaggaacacaagauaaucaacgcaauagagaacaaagaaaccauccuaaucacagacaagucaggaaaucgaaaaaggguauucaaagcccccaugcccaacuucagacagacagccaaacaauaucuggaagaaguacucaucagccacaaagcaaagaauaaggucgugacaaagaacaagaacaaaauucuagggaaagagaaaauacaggaaacgcugacaccacgcggccagcuccacgaccagacuaucuacggguucaacugguggucuagaaucacauugucaaagaaaguaagccggaacgagaucgagaaaaucauagacaacaacacgaaauucuuccuccaagaguucauccaacugaaaggaagcaucgcaaaggccuucagcgacgcagaacuaaacaaacuaauguacaaggggaaaauauugaaagaaaucgagguggcgauuccaugcuacacucagcgcaucgauaucuccaaaguuuucacggacucgcaaaaaucaaacuccgcaaaagagaaaaacauuaaaaacauacucgaccugaagguaagaaacauccuucagaaucgccucuccgaguucaaaggcgacuucaaaaaggccuucucggaccucgacaagaauccuauaugguucaacaaggaaaaagguaucucgaucaagcgcgugaucauaucaggagugaagaacguggaaccguugcacuacaagaaagaccaccuaggcaacgacauacucgacggcaaagaaaauagaaucccgguggacuucaucagcacaggaaacaaccaccacguagcuauauaucaggaugaaaaaggcaaccuccaagaaaagguagucucccucuucgacgcaguaaagcucgugaacgccgaugaacccguaauagacaagacuuacaaucagggccugggguggcaauuccuauucacuaugaagcaaaaugaaauguucguauucccgaacgauaacacgggauucgaccccaaagaaauagaccuccuugacccgagcaacaaaaagcucaucucgccaaaccucuucaggguacaaucaaucaguauagugcaauacgggaacaacaucgucagggacuucaaauuccgcaaccacuuagaaagcguccucaacgacgacaaaguccuucacggcauaacauuccaacaaaucaagagccuuggcccgcugcuaaacauagugaaagucagaauuaaccaccucggcgacaucguguccguaggcgaauacuga

SEQ ID NO: 6797 - RNA, 4260 nt, Artificial Sequence
  Cas9 variant
auggccaagccacaaaacuacaccaucggauuagacaucggaaccaacucgguuggguggacaguaacagacgaccaaaacaacauccuacgaaucaaaagcaaaaaggccaucggcgccagauuauucgaagagggaaaggucgccgccgagagacguucauuccguaccacgcgacgcagauuaucgcgcagaaaauggcgaauaaaacuacuugaagaauuauucgacgaggaaaucucgaaggucgacccgaacuucuucgcccgaucgcacgaauccuggauaucccccaaagacaaacgagagcgcuacagcgccaucguuuuccccacccccgaagaggacaaaaaguuccacaacgaguaccccacaauauaccaucucagagaccggcugaugaaagaugaccaaaaacacgacauccgagagauuuacguugcaauacaucacaucaugaaauacagggggaacuuccuccacgaugaaucaauagagaccuaccgcagcggcaugagcagucucggagguggcgacgaacgaaccauauugaacacgaagauacucgaugaccugaacgacgcauucgcggacaaccuagccacccagggaauauccgucaacagcgcaucggccgaccagauaaacgaaauagugaccagcggccaccucaaugucgacagucaaaaggcgaucgcgaagcuacuucuccccacgacucucucgagcgaugacaagaaacaggacaagaaaauuaagaaacuggccacagacgcagcgaaaaacguagcgagcgcauggcucggcuacaaagccaacuucgccgcaauacucaauauccaagaagucgacaaagauaaaaagaaaaucuacucauuugcgcuacaaggggccgacgaagaggacaaagucgagacccucgaguccguucugucccaagaccaaauagagaucguggaccggaucauccguauacgccaugcgaucgugcuaggcgagaucauccccguaggcaugacacucagcgaggcaaugauugaaaaauacgaccaacacgccaaagaccugaaaaaccucaaaacggucauacgaaaccucaaagaucggaaaaaugcggucaagcugcaagccaucuacgaucuguacguaaacaaccgucacgccgacacagcaaaggcaaugaaacuggcaggcgucaaaaagcgaacugaacuucuggaaccggaagaguucaacaaauccauagaaaaacuacuagacgacuccccagucagugccgaaaucaagaaacgcaucgcugaaaaagacuuccuuccccuccaacgaucaaacagcaacggugucaucccgaaccaacuucaccaaaucgaacuagacgaaauaauaaagaaacaaucaaaauacuaccccuuccugggggaaaccaaugaacacgccuccgccgaugucgcccgcaaagcgcccaccaaacucgaucaacuacuaacguucagggugccuuacuacgugggaccccuaaucacuaaagaggaacaagaagaacaagacggccacucauuugcauggaugauccgcaaaaaccccaaagaccacgagaaaaucacacccuggaacuuugacgaaaaaguagacaggauggcguccgccacacaauucauaaaaaggaugaccacuaaagacaccuacuuacuuggugaagacguucucccaucguccucacuuaaauaccagcuguucacaguucugaacgagcugaauaaccugcgcauaaaccacaaaaagcucacgcgagaggaaaaagaacaaguaauugaagaccucuucaagaaauacaaaaccgugaaggcggauaaguucaaaaacuacuggcaaaaaggccacgccggccucgacguaaagauacaaggcauggccgacccugagaaguucaacagcacaaugucgacguauaucgaccugcaaaagauauuuggagaccagcuggacgacgcccagagacaaaacgacuucgagaagauaaucgaauacagcacaauuuucgaagacaggaaaauccucggggaaaaacuucgagccgacuucguauggcuuagcgaggaucaaaucaaaaggcucugcagacugagacuucaaggauggggacgccucucccucaagcuccuuacuaggcuaaccgaugccgauggacagaacguccucgagcgacuccuaaacuccaaugacaauuucaugcagauugucaaggacccugucauaaaagccaagaucgaacagaaaaaccaaaagcugcuccgcgccgauuggagcgaaaacgcaacagaauccauccucgacgaagcguauaccucgccccaaaacaaaaaggccauccgccaggucaugcgcgucguccaugauaucguaaaagccugcgacggaaaccugcccgcaaaauucgcaaucgaguuugcccgaucacaggacgacgaccccaaacgaaccguugcacgagcggaccggcuccagaaaaucuacgcgcaaauuagugacgaagucgucagccaaggaguaaaagaucaacuaagcggcaugaagucacucaaggaccgauauuaccucuauuucaugcaaggagggcgugacgcguacacagggaaaccccucaacauagacagacuguccgauuacgacauagaccacaucaugccgcaaucauucaucaaagacgacagccuggacaaccgaguacucgucacacgugccgugaacaaccaaaagagcgacaaugucccgguacuccuauauggaaaccaccuagucgccgacuuaggcaucaccauccgugaaaugugggaccgcuggcaaaaauccggaaugaucaguaagcgaaagcuagccaaccuacuaacggaccccgccacccucagcgaguacagggcugaaggauucauaaaccgucaacucgucgaaacaagccaagugaucaaacucaccgcaaccaucuuacagagcgaguuccccgauagcaaaaucauagaagugccagccaaguacaauuccauccuccgaaagcaguucgaccucuauaagucaagggaagucaacgacuaccaccacgcaauugacgcauaccugucgacaauagucggaaacuauuuauaccaagucuaucccaacuuacgccgccucuuuguauacggcgaguucaaaaaguucucgcacggggaagaagaaucaucccaccaagccgucagacgggucaagagcaugaacuuccuagacgaccuacuccgugggaaacacggcgacgacaucuauugccguguuaccggcgaaguaaucuucucgagaaaagacaucauaagcaaacugaaacaagcguauagcuucaaacaaaugcucguaacacaggaaguguuuacgaagaaaucugcucucuucgaccaaaccguguacccaucucccgcccgggacagcaaaacccgaagcggacucaucccccgaaaacaaggcauggauacagagauauacggcgguuacucaggaaacaaagacgccuacuucgugcucgcacaaguagucaagagcaagggccacaccuuacaaguaguuggugucccuauacgugcgcucagagcucuagccaacugcuccaacuacagcgaacagcuacucaagauuguuaaggcccaaguccuauucaacaagaaaaccgggaaagcgaagaaaggcauuuccgacguccgcauccuucuagacaaaauccccuaucggcaacccguccuagacgguagcgccuucuacaugcuagggaguuccacauacaaauacaaccuaaaacagauaucucuaucacaacaaucaaugaaauacauccuagacuacauugacgacccaaacuucaauaaacacgaaaugacaaaaauagaccaacaaaacgagaaagaaugccuucucuccguuuacgaugagauacucgacaaaauggacaaauaucuaucacuauacgacauaaauggcuuucgcaagaaacuucacguggggagagacaaauucauaaaacuagaaguugagaaacaagccgaagcaaucaaaaacguccugcggggguuccacgccaacuccgacaugaccaaacuauccgaccucggccuauccaccagccucggcuucaugcaagccagcgacggcauuaaacuauccgacaaugccguauucauauaccaaucacccaccggacuauucgaacgaagagucaaaguauccgaccucuuaaaauga

SEQ ID NO: 6798 - RNA, 4260 nt, Artificial Sequence
  Cas9 variant
augaugaucaaaaauauccugggacucgaccugggaacuaacuccauaggaugggcucuaaucaaacaaaacuucgagaacaaguacggcgaaauucugggcaugggaucccgcauaauuccaaugagccaagacgugcucggggaguucggaaagggcaauucaguaagccaaaccgcggcacgaaccggcuacagaggaguccgccgacuacgcgaacgcuuccuacuccggagagaacgccugcaccggguccugaacguacucaacuucuuacccgagcacuacgccucccaaauugacuuugagaaacgcuucgggaaauucaaguacgaaaccgaaccaaaacucgccuauaacaacgauggauucuucuucaagaacagcuucgaugaaaugcuuggugacuucaaagaccaccaauuccaccuacuagagaacgggcggaaaguaccauacgacuggaccaucuacuaccuucgaaagaaggcccuaagccagaagauagaaaaagaagaacuagcauggaucuugcuaaacuucaaccagaaacggggauacuaccaauuacgaggagaggacuucgaggaggagaaagaccgcgucuucgucagacuaaaaguagaccgcguggucgacagcggcgagaacauaaaaggcaaaauacucuacgacguuuacuucgagaacggcuggaaauacgaaaaacagaucgugaagacggaagacuggaucggccgaaccaaagaguucaucguaacagaauccauccuaaagaacggcgacacaaagaggaccuuuaaagccguugacagcgaaaaggacuggaucgccauuaagacaaaaaccgaacaagagauagacaagucacacaaaacugucggagcauacauauaugaggcacuccugcaaaaucccaaacagaagaucaaaggcaaacucguuagaacgaucgagcggaaguucuacagagaagaacuaaagaaaauccuggaaaggcagaaagaauuucacccagaauuacaaagugaugaccuauacaacgacugcaucagggaacuguaccgcaacaacgaagcgcaccagauuacccucuccaagaaggacuucguccaccuucuccugaaugaccucaucuucuaccaaagaccacugcgcucccagaaaaguuccgucuccaacuguacacucgaguucagaaaguacaaagacgaaaacggcgucgaacacgcacaauaccuaaaaacaauacccaagagcaauccauacuaccaggaguuccggguguggcaauggauguucaaccucaacauauaccggaaggaugacgacacgaacguaaccaaagaguuucuauccuccacugaagacuaugagacgcuuuucgaguuccuaaacaaccgcaaggaagucgaccagaaagcacuccuucgccacuucaaacucaaugagaaaacgcaucgauggaacuacguggaagacaagaaauacccaugcaacgaaacaaaaacgaugaucuccacccgccuggagaaagucgaaaacuaucccucagacuuccucacccgcgaaauggaacagaacaucuggcacaucauauacuccgucaacgauaagaucgaauacgagaaggcacucaaaucauucgcccacaaaaacaaccucgacgaaaacagcuucuucgaagcguucaaaaaguucccucccuucaaaagcgaauacggcagcuucuccgaaaaggcgaucaagaaacuacucccgcuccuucgacuaggcaaguacuggaauugggaguccauagaccgaaagucccaagggcgcaucgagaagaucauuacaggcgaauuugacggaaauauaaaggacaaaguccgagagaaggcaauacaccucaccgccgaaaacgacuuccagggauuacaacuauggcuggcucaguacaucgucuacggccgucacuccgaggcuuccaugaucggaaaguggaacuccgccgacgaccuagaggaguuccucaaagguuucaaacagcacucacugcguaaccccaucguagagcaagucaucacggagacacuccggguaguaaaggacauauggcuuaaguacggcaacggagcaaaagacuucuucuccgagauucauaucgagcucgggagagagaugaaacaaacgaaagaugagagagucgacgccaccaagcggaucacagaaaacgagaacacgaaccuccggaucaaagcauugcucgccgaaaugaugaaugauaacagugucgaaaacauccgaccuuacucccccaugcaacaagagauacugaaaaucuacgaagaugguauauuaaaaucagacauagaaaucgacgaugacauccuaaagauaagcaagacugcacaacccagcagcuccgacuuaaaaagauauaaacuauggcucgagcagagguacaaaucaccauacacgggccaaaucaucccccucaacaaacucuucacgucagaauacgaaauagagcacauaaucccccagucgcgauauuucgacgacagcuucucaaacaagaucaucugcgagucagccgucaacaaacuaaaagacaacuacaucggacuuggguucaucaaacaguucggcgguaugaucguugaauguggcuucggcaaguccgucgagauauucaaggcugaggaauacgaggauuuuguaaagaagcacuaugcuaacaaccgcagcaaacgaaacaagcugcuacucgaggagauaccggagaaaaugauagaccgccaacucaaugacacacggcacaucagcaaauacauaucagggguacuuuccaacaucguacgccaagaagacggaaccgacgaagggguaaacucuaagaacaucguaccgggaaacggaaaaauuacaacacaacucaaacaggacuggggacucaaugacguauggaacgaacugauccuccccagauucgagcggaugaaccagcuaacgaacucgacggacuucaccagcuggaauaaaaaccaccagaaauuccucccaaccguacccaucgaguucucgaaggguuucucgaagaagagaauagaccaucgccaucacgcaauggaugcgcuagugaucgcaugcgcaacaaaggaccacaucaaccucuuaaacaaccaaagugccaaaagcgacacgaaacgguacgaccucaagcgcaaacuuaugaaauucgaacgggucguuuacagccacucaaagacgggggagaaaauagagaaggagguccccaaacaguuccuaaagcccugggacaacuucacagucgacgcaaagaacaagauggaaacuaucauagucucuuuuaagcagaaccuccgggugaucaacaaggccaccaaccacuacgaaaaauggaucgaaaaggacggaaucaagcgcaaagaacucaucaaacaagaagggaccaacugggcaauuagaaagcccaugcacaaggaaaccgucuccggcaaaguugaccuuccaggcaucaaaauccccaaaggaaaaauacucacggcgacccgcaaaucucucgacacauccuuugaccucaaaaccauaaacucaaucaccgacacaggcauccagaaaauccuaaagaacuaccucgaguucaaaggaagcucagaacuagcguucuccccagaaggcauagaagacaugaacaaaaacauugaaaaguucaacgacggaaaaccgcaccaaucaaucaacaaagugcggaucuucgaacucggauccaaauucucagugggacaaacuggcaacaaaaaggacaaauacgucgaagcagccaagggaaccaaccuguuuuucgcgguauacgaagacaaaaacggcaaacgauccuacgaaaccaucccacucaacgaagugaucgaacggcaaaaacaggggcucgacagcgugagcuucaaaaacaaagaagacuuccuccucugcccgaacgaccugguuuacguaccaucagaggacgaacuggagaauaucuacaacauagacuucaaaaaccucacgaccgagaaaaccggcaacaucuacaaagucguuucuuucucagggaaucagauauucuucaucaggcaagacaucgcaauuucaaucgucaacaaagccgaauuuagcacuuuaaacaagauggagcgcgcgaucgacggcuccaugauuaaagaaaauugcauaaaacuaaagauagaccgacuaggcaacaucgccaaaaucuga

SEQ ID NO: 6799 - RNA, 4263 nt, Artificial Sequence
  Cas9 variant
auggcuaagccaaaggauuacaccauaggauuagacauuggcaccaacagcgucggauggguaguaaccgacgaccagaacaacauacuacgcaucaaagguaagaaagccaucggagcacgccuauuuaccgaaggaaaaguagcagcggaaagacguagcuuccgaacgacccgacgcagacuaucgcgacguagauggcgcaucaagaugcucgaagaacucuucgacgaagagauagcaaaagucgaucccagcuucuucgccagacuccacgagagcuggaucucacccaaggauaaacgcaagcgcuauucggccaucgucuucccuaguccagaagaagacaaaaaguuccacgagucguacccgacaaucuaucaucugcgagauaaacuuaugaaggacgaccagaaacacgacaucagagaaaucuacauugccguacaccaaaugaucaaagcccggggcaacuuccugcacgacgagagcguagaaacauaccgcuccggaauguccucacugggcggccgaucagaacgcacaauacuaagcgugcaaacgcucgaagaacucaacgaccuauucgccgaaaacgaagggacagaagaaguggaacucaacgucgccagcgcggaacagauuaacgacauccuuacaggaggccaccucaacgccgacucgcagaaagaaaucuccaaccuccuccucccgaguuccuucccauccuucgacgacaaagcgaaagaaaaacaagucaagaaacucaucaacaaugucgcaacaaacaucagcaaagccuggcuaggcuauaaagcggacuucucaacgauacucaaucuggccaaggucgacaaagaucaaaagaaaaucuuugcauucgcccuacagggcgaagacgaggaagacaaaguccaagaacuggaaagccuccucgaacaaagucagacagacauaguagaccgccuaaucgaaaucagacacgccaucguccugagcgaaaucgucccagucggaaugacccuauccgaagccaugauugacaaauaugaccaacacaaagaagaccugaucacauuaaaagccgugauacgaaauacaaaagacaagaaaaaggccgcuaagcuccaagccaucuacgaccucuacgucaaaaacagacacgccgaccucgcaaaagcgaugaaacucacaggcauaaagaaacguuccgaacuucuggacccagaggaacucaagaaaggcaucucgagccugcucgacgacucuccugaagcgguagaaaucaaacaacgcuuagaagagaagacauuccucccccuucagcgcucaaacaauaacggcgucauaccgaaccaacuacaccaaguagagcuagacgagaucauaaagaaacaaagcaaauauuaccccuuccuggcggagaaaaaccccgacgaaucagaagaagcccagaaaaaggccccuacuaaacuagacgcgcuccugacuuucagagucccauacuacguaggaccaaugaucaccaaggaagaacaggaggcacagaacggccacuccuucgcguggaugguccgacgggacccacaagaucacgaagcgauaacacccuggaacuucgaaaagaaagucgacaaaauggccagcgcgacgcaguucaucaaaagaaugaccaccaaagacacauaccuucugggugaggacguccuaccagccucaagccucaaguaccagcuauuuacgguacugaacgaacuuaauaaccuccgaguaaacgggaagaaauugacgagcgaugaaaaagaacaagucauagagggccucuuuaagaagcaaaagacugucaaggcggacaaauucguaaaauacuggcaagccaaacacaucggagcugauaucaaaguuaaaggccugucagacccuucuaaauucaauucuaccaugaguaccuacaucgauuucaagaaaauauucggcgaccaauuaaaugacgucaauagacagaacgacuucgaaaagaucaucgaauacucaaccaucuucgaagaccgcaagauacuugaggacaaacugcgcgcagauuucgccugguuauccgaagaacaaaucaagcagcuaugucgccuuaggcuucagggauggggucgccugagcgacaagcuacugacccgcuugacagacgccgacggacaaaacguccuagaacgacuguggaauagcaacgacaacuucguacaaauagucagcgacccuaauaucaaagccaaaaucgagcaagagaaccagaaacuccuccgagacucccaauccgacaaugcgguagaaagcauccuggacgacgccuauacaagcccacaaaacaaaaaggcaauccgccaggucaugaggguaguccacgacauugucaaggcaugcgacggcaacguccccgccaaauucgcaaucgaguucgcgaggagccaagaagacgacccaaaaaggacgacggcaagagucaaccaaaugcagaaaaucuacgaccaaaucucugacgagguaguaucacaaggcguaaaggagcaacugucagguaugaagucacuaaaagauagauacuaucuuuacuucaugcaagggggccgcgacgcguacacaggugccaagcugaauaucgaccggcuaucggacuacgacgucgaccacauaaugccccaaaguuuugugaaagacgacucacuagacaauagaguccuagucgcccgagcagucaacaaccaaaaauccgacaaagucccagcccuccuguuuggaaauaaagucgucgccgaucuagggaucaccguccgggagaugugggacaaauggcagaaacuggggaugauaucaaaacgcaaacucuccaaccucuuaaccgaucccgacgcauugacagaguaccgcgcacaaggauucauccgacgccagcuagucgaaacgucacaagugaucaagcucacagcaacaauucuccaaagcgaguucccugacagcaaaauuaucgaaguacccgccaaauacaacagcaucguccgaaagcaauucgaccucuacaagucccgagaggucaacgacuuccaccacgcgauagacgccuacuugagcaccaucguggggaacuaccucuaccaggucuaccccaaucuccgcagaauguucguauacggggaguucaagaaauucuccaguaacgccgaagaaagcgcccacgacguagcucgccgcguuaaaucaaugaacuuccuugacgaucugcuccgaggcacacacggcgacaacaucuacugccgcucaaccggggaaaucgucuucaaccgcaacgacaucaucagcaaacuaaagcaagccuauagcuucaaacaaaugcucgucacgcaagaagucuucacgcgcaagagcgcccucuuugaccaaacagucuaccccuccccugaacgagauucaaagaaacgcagcgggcuaauaccccggaagaaaggcauggaccccgaaaucuauggcggcuaugcacacaaccaagacagcuacuuuguacucgcuaaaaucgagaaagucaaaggcuacacacuucaaauagucggcgugcccaucagaucacuggaaauaaucaacaaagccgaggauuucagcacagccuuacuagacauuaucaaaagcaaagucauguacaacgagaaaaccggccaaccgaaacgcggaauaaagaacguagagauccuugugaacaaacucccauacagacaacccauuuuagagaaagacguaagcuacaugcucggcucuagcgcguauaaguacaacaugaaacaaauaacccugagccgccagagcaugaaauacauacucgacuacauagacgaccccaauuucacuaaacacgaaaugaccaugauagacgagcaaaacgaacgcgaaugccugcucagcguguacgacgagauacucgaaaaaguggacaaauaccuaccccuauuugauggcaacaaauuccgugaaaaacugcauagcgcgcgaaaggaguucgucagccucagcgucgacgacgaagcaucggcaauugagaagauccuucgaggacuccacgcgaacagugaaaugccaucacucgagaaucugaaaaucaaacccgcccugggauucuuccagaugaagaacggaauaacacuuaguaacgacgcagugcuguuauaccaaucgccgacgggccuauucgaacgccgcgucaaaguauccgaccuccuaaaguga

SEQ ID NO: 6800 - RNA, 4263 nt, Artificial Sequence
  Cas9 variant
auggccaagccaaaagacuauacuaucggacucgacauaggaaccaacucggucggaugggugguaaccgacgaccaaaacaacauacuuagaaucaaggggaagaaagccaucggagcgcggcuauuuaccgaggguaaagucgcagcaaaacgacguucauuccgcacgaccagacgccgccugucacgaagacgcuggcgaauaaaacuccuagaggaacucuuugacgaagaaauagccaaagucgacccaucuuucuucgcacgccuccacgaaucauggaucucuccaaaagacaagagaaagcgauacuccgccauaguauuccccucacccgaagaggacaagaaauuccacgagucauacccaacuauauaccaccuacgggacaaacuaaugaaagaugaccagaaacacgacauacgggaaauauacaucgccgugcaccaaaugaucaaagcacggggaaacuuccuacacgacgaguccguagaaacuuaccgcucugggaugucaagccucggugggcgcagcgaaagaacaauacucuccgugcaaacccuggaagaacucaacgacuuguucgcagaaaacgagggcacagaggaagucgagcuuaacguagcgagugcugaacaaaucaacgacauauuaaccggcggccacuuaaacgccgacagccagaaagaaauuuccaaccuccugcucccaaguuccuucccauccuuugacgauaaagccaaggagaagcaggucaagaaacucaucaacaacguugcgaccaacauuucgaaagccuggcuggguuacaaagcugacuucagcacaauucugaaccucgcaaaagucgacaaagaccagaagaaaauauuugccuucgcccugcagggggaagacgaggaagacaaagugcaggagcucgagagccuacuagaacaaucucagaccgacauaguagaccgccuaauugaaauccgccaugcaauuguacucucggaaaucguccccguaggcaugacacugagcgaagcaaugauagauaaauacgaucaacacaaagaggacuugauaacacucaaagccgugauccgcaacaccaaagacaagaagaaagccgcgaaacuacaggccauuuacgaccuauacgucaagaacaggcacgccgaccucgccaaggcgaugaaacucaccggaaucaaaaagagaagcgaacuucucgacccggaggaacuaaagaagggaaucucgagccugcuggacgacucaccagaagccguagagauaaaacaacgcauagaagagaaaacuuuccucccccugcaaaggagcaacaacaacggagucaucccgaaccagcuacaccaaguagaacucgacgagaucauaaagaagcaauccaaauacuacccauuccucgcggaaaagaacccugacgagagcgaggaagcgcagaaaaaggcccccaccaaauuagacgcacuucucacauucagaguacccuacuacgucggcccaaugaucacgaaagaagaacaagaagcgcagaacggccacuccuuugccuggaugguccgacgagacccacaagaucaugaagcaauaaccccuuggaacuucgaaaagaaagucgacaagauggccucagccacgcaauucaucaaacguaugaccacgaaagacacauaccugcucggcgaagacguucucccagccaguucacugaaauaccaacucuucacagugcucaacgaacucaauaaccuacgagucaacgguaagaaauuaaccucagacgaaaaagaacaagugaucgaggggcucuuuaagaaacagaaaacgguaaaagcggacaaauucgucaaauacuggcaagccaaacacauaggagcggauaucaaaguuaaaggccucagcgacccaucuaaauucaacagcaccaugucaaccuacaucgacuucaaaaagauauucggcgaucaacucaacgacgucaaccgccaaaaugacuuugagaaaaucauagaauacuccaccauauuugaagaccgaaaaauuuuagaagacaaacugcgaguagacuucgcuuggcugucggaggagcaaauaaagcaacuaugccgccuacgccugcaaggaugggggcgucuguccgacaaacugcucacacgacuaacagacgccgauggacaaaacguacuggagcggcuguggaauagcaacgacaacuucguucagauagucagcgacccaaauaucaaagcaaagauagagcaagaaaaccaaaagcuacugagagacagccaauccgacaacgcgguggaaucuauacucgaugaugcauacaccagcccgcagaacaagaaagcaauccgucaagugaugcgaguggugcacgacaucgucaaggccugcgaugggaauguacccgccaaauucgcaaucgaguucgcacgaagucaggaggacgacccuaaacggacgaccgcacgcguaaaccaaaugcaaaagauauacgaccaaauaagcgacgagguagucucccaaggaguaaaagaacaacuauccggcaugaagucguugaaagaucgguacuaccucuacuucaugcaagggggccgcgacgcauauaccggcgccaaguuaaacaucgaccgccucuccgacuacgacgucgaccacaucaugccucagagcuucgucaaagacgacagccucgacaacagaguccuagucgcacgcgcggucaacaaccagaaaagcgacaaggucccugcccuacuauucgggaacaagguaguagcggaccugggcaucaccgucagggagaugugggauaaauggcaaaaacuaggcaugauaagcaaacgaaagcuaaguaaccuacuuaccgacccagacgcucugaccgaguaucgugcucaaggcuucaucaggcgccaacucgucgaaaccagccaagugaucaagcucaccgccacgauacuccaaucugaguuccccgacagcaagaucauagaaguuccggcuaaauacaacagcauaguaagaaaacaauucgaccuauacaaaucccgggaagucaacgacuuccaccacgccaucgacgcauaccuuagcaccaucgucggaaacuaccucuaucagguauacccgaaccugcgccggauguucguauacggcgaguucaagaaguucucaagcaacgccgaggaauccgcgcacgacgucgcccgccgagucaaaucaaugaacuuccucgacgaccuucucagaggcacacacggggauaacaucuacugccguagcaccggggaaaucguguuuaaccgaaacgauaucauuucgaaauugaagcaagcguacagcuucaagcaaaugcucguaacccaagaggucuucacuaaaaagagcgcccuauucaaccaaacagucuauccaagucccaaacgcgacggguccaaacgaucaggccuuauaccccgcaaacgaggcauggacccugagaucuacggaggauacgcacacaaccaagacucucacuucguucucgccaagauagaaaaagugaaaggguacacgcuacagauagucggaguaccaaucagaucauuagaaaucaucaacaaagcugaagauuucucgaccgcccuauuagacaucaucaagucgaaggucauguacaacgaaaagacgggccaaccaaagagaggcaucaagaacguggaaauccucgucaauaaacugccauacaggcagcccauacuagaaaaggauguauccuacaugcucgggucauccgcauacaaguacaacaucaaacaaauaaccuuaagucgacaauccaugaaauacauacuugauuacauagacgaccccaacuucacgaaacacgagaugaccaugaucgacgagcaaaacgagcgcgaaugccuacucucggucuacgacgaaauccucgagaaaguagacaaauaccucccccuguuugacggaaacaaauuccgcgaaaaacuacacucagcacgaaaagaguuugucucgcugucagucgacgacgaggcgucugccauagaaaagauacucagaggacuccacgcuaacuccgagaugcccucccuggaaaaccucaaaaucaagccagcacucggcuucuuccaaaugaaaaacggcauuacacucagcaacgacgcaguccugcuguaccaaucacccacagggcuauuugaaagacgagucaaaguguccgacuugcuaaaguga

SEQ ID NO: 6801 - RNA, 4263 nt, Artificial Sequence
  Cas9 variant
auggccaaguucaacaaaaacuacucgaucgggcuggauaucggcgucuccucggucggguacgcugucgugaccgaugacuaccgcguacccgcguucaaauucaaaguacuugggaacaccgaaaaagagaaaaucaaaaagaaccuuaucggcagcaccacguucguccccgcgcaguccgcgcagggcacacgaguuuuucgcgugaaccggcgccgcaucgaccgccgcaaccaccggauagccuacuuacgcgacauuuuucagaaagaaaucgaaaaagucgauaaaaacuucuaucggagauuagacgaauccuuccguguacuuggcgacaaguccgaagaauuacagaucaaacaacccuucuucggcgacaaagaacuggaaacggccuaccacaaaaaguauccuaccauauaccaucuccgcaagcaccucgcagaugccgacaaaaacucaccgguugcagacaucagggaaguauacauggcaaucucacacauccuaaaauauagggggcacuuccuaacccuugaccgcaucaaccccaacaacaucaacaugcagaacagcuggaucgacuucaucgaauccugccaagagguuuucgacuuggaaaucucggacgaaucaaaaaccaucguagcuaucuucaaguccagcgacaaccgccaggaaaaagugaagaaaauccucuccuacuuucagcaggaacuccuaaagaaggacaagucaaucuuuaaacaacuccuucaacuacuguuuggccuaaaaacuaaguucaaagacuguuuugaacucgaagaagaacccgauuuaaacuucagcaaagaaaacuacgacgaaaauuuagagaacuuccuaggaucccuagaagaggauuucucugaugucuuugcgaagcucaaggugcuccgggacacgauccugcuauccgggauguuaaccuacacaggcaccacucgcgcccgcuucuccgcaacaaugguugaaagauaugaggagcaccgcaaagaccuccagcgauucaaauccuuuguuaaacaaaaccucagcgaacaagacuaccuugacaucuucggccgcaaaaccccaaauggauucgacgucgacaaagagaccaaaggcuacguuggguacauuucgaacaaaaugguacucacaaacccgcaaaaacagaaaaccauacagcaaaacuucuacgauuauauaucuggcaaaauuacaggcaucgaaggagccgaguacuuccucaacaaaauuucagacggcaccuuccucaggaaauuacgaacgacagacaauggcgcuguacccaaccaaauccacgccuacgaauuagagaaaaucaucgaccgccaaggggaagacuacccguuccuucuugaaaacaaagacaagcuccucagcauccugaccuucaagaucccauauuacgucgguccccucucaaaagggaacaacucacgcuucggauggauuaaaagaaccaucagccaagacaucuuagacgacaaugacgaagacacacgcaacggaaagauaaggcccuggaauuaccagaagcucauuaacauggacgaaacccgagacgcauuuauaacaaaccuuauaggcaaugacaucauccuucucaaugaaaagguccucccaaagagaagucuaauauacgaagaaguuaugcuucaaaacgaacuuacccgcguaaaauacaaagacaaauacggcaagacacacuucuucgacuccgagcuccgacaagaaauaaucaacaaccucuucaaaacaaacaacaagcgagucucauccgcgaugcugcucgacuaucucgagaacuacacaaauuugcaggccgucgaaaucguauccgggauugaaaaaggcaagucccugaacagcacccucaaaacauauaacgacuugaaaacuaucuucagcgaggaacugcuagacucugaaaucuaccagaaggaacucgaggaaauaguaaaagucaucaccguauucgacgauaagaaauccauuaaaaacuaccuuauaaaauauuucggccaccuggaguucuuaaacgaggaacgcauaaaccaauuaucuaaacuacgcuacaccggaugggggcgauacuccgcaaaacucuuacuagauauccgcgacgaagacacaggcuucaaccuaaugcaauuccuccggaacgacgacgagaauagaaaccuaagccagcucaucuccgacucaacccuauccuucgauucggcaaucaagucuauccagagcaaguccacagucgaagacgacgucuucgacgaaaucaagaagcucgccggcagccccgcaauaaagcguggcauccucaacucuauaaagaucguggacgaacucguccaaaucaucggauauccaccucagaacauagucaucgagauggcccgagaaaauaugaccacggaagaaggccaaaagaaagccaaaacccgcaaaaccaaacuagagucagcccucaaaaacauagaaaauucaguauuggaaaauggaaaagucccccacucugacgaacaauuacaaagcgaaaaacuuuaccucuacuaccuacaaaacgggaaggacauguacucacuagacaagacaggcucccccacaccccuauaccgggaccaacucgaccaauaugaagucgaucacaucauaccuuacucguucuugccgaucgacuccaucgacaacaaaguccuaacacaccgcgaaaacaaccagcgcaaacuaaacaacaucccagacaaagaaaccguagccaacaugaaacccuucugggagaaacuauacaaugccaaauugauaagccaaaccaaguaccaacgacucacaaccucggaaaggacgcccgacgguguccucacagaguccaugaaagcaggcuucaucgaacggcaacucgucgaaacccgccaaaucauaaaacacgucgcacgaauccuagacaaccgcuuccucgacacaaaaauaaucgcacuuaagagccaacuaauaaccaacuuucgaaacacauuccauauagcaaaaauacgcgaacuaaacgacuaccaccacgcucaugaugcuuaccucgcagucgucguaggucaaacccuucuaaaagcauacccgaaacucgcgccugaacucauauacggccaccacgcccauuucaaccgccacgaagagaacaaggcgaccauacgaaagcaucucuacucaaacaucaugcgauucuucaacaacccagacucaaaagucucaaaagacaucugggacugcaaccgcgaccuuccaauaaucaaagaagucaucuacaauagccaagucaacuucgucaaaagaacuaugauaaagaaaggagcauucuauaaccaaaaucccgucggcaaguucaacaagcagaucgcggcaaacaaccgauacccacugaagacaaaagucuccucgcucgacacuagcaucuacggaggcuauggcccaaugaacagcgcccuaucgaucaucauuaucgccgaacgcuucaacgaaaagaaaggaaaaaucgagaccgucaaggaguuucaugacauauucauaauagacuacaagaaauucaacaacaacccguuccaauuucuaaacgacacaucugaaaacggcuuccucaaaaagaacaacaucaaccgcguucuagccuucuacggcguuccuaaauacagcuuaaugcagaaaaacgacgggacacgcaugcuauucgaaagcaagucgaaccugcauaaagcuacgcaauucaaacucacuaaaacgcaaaacgaacucuuuuuccauaugcgccgccugcuuaccaagagcaaccuaauggaccucaaaagugagucagccauuaaggagagccaaaacuucauacugaaacauaaagaggaguuugacaacaucuccaaccagcucucggcauucucucaaaagaugcuaggcgacacaacgucccuacgcaaccuaaucaagggguacaaugaaagaaaaaucaaggaaaucgacagcuccgaggaggucauaaaauacuucuacgacaacuucauaaaaauguucucauucgucaaauccggagcaccgaagggcaucaacgacuuuuucaacaauaaauacaccguagcacgcaugcgcccaaaaccagauaagaaauuucucaacgcaacgcuuauacaccaaucgaucaccggacucuaugaaacccgcauagaucucucaaaacugggagaagacuga

SEQ ID NO: 6802 - RNA, 4263 nt, Artificial Sequence
  Cas9 variant
auggcgaaguuuaacaaaaauuacuccauuggacuugacaucggcguaagcuccguuggauacgcaguggucacagacgacuaccgcguccccgcauuuaaauucaagguccucgguaacaccgaaaaagaaaagauaaagaaaaaccuuaucggcucgacgacauucgucccagcgcaauccgcccaggggacccgggucuucagagugaaccggcgccggauagaccgucggaaccaccggaucgcguaccuucgcgacauauuccagaaagaaaucgaaaaagucgacaaaaacuuuuaccgccgucuagacgaauccuuucgcguccugggagauaaaagcgaggagcugcaaaucaaacagcccuucuucggagacaaagagcucgaaacagccuaccacaagaaauaccccacgauuuaccaccuccgcaaacaccuagccgacgcagacaaaaacucaccuguagcugacauacgagaagucuacauggccaucagccauauacuaaaauaccgcggucacuuuuuaacccucgaccgcauaaaucccaacaacauaaauaugcaaaacuccuggaucgauuucauagagucaugccaagagguauucgaccuagagauaucugaugaaucgaaaacaaucgucgcaauauucaaauccagcgacaaccgccaagaaaaagucaagaaaauacuuaguuacuuccaacaagaacuccucaagaaagacaaaagcauuuucaaacaacuacuccaguuacucuucggccucaaaacaaaauucaaagacuguuucgaacucgaagaggaacccgaccuuaacuucuccaaagagaacuacgacgaaaacuuggaaaacuuuuugggcucacucgaagaagauuucagcgacguguucgccaagcuaaaaguucuacgcgauacgauccuccucagcggaaugcucacauacacgggcaccacccgcgcccguuucucugccaccauggucgaaagauacgaagaacaccgaaaagaccuccaacguuucaagagcuuugucaaacaaaaccuaucagagcaggauuaccucgacauauucggucgcaagacaccaaacggauucgacgucgacaaagaaacgaaaggcuacgucggcuacaucucgaacaagaugguacuaacgaacccgcaaaaacagaaaacgauccaacaaaacuucuacgacuauaucuccggcaaaauuaccggcaucgaaggugcagaauacuuccucaacaagauaagcgacggcacuuuucuccgaaaacuacgcacgaccgacaauggagcagucccuaaccagauacacgcuuacgaacuagagaaaaucauagaccgacaaggcgaggacuaccccuucuuacucgagaauaaagauaagcuacucuccauacucaccuucaaaaucccauacuacguuggaccucuauccaaaggcaacaacucaagauucggcuggauaaaacgcacgauaagucaggacauccucgaugacaacgacgaagauacccgcaacggaaagauucgcccuuggaacuaccagaagcucauaaacauggacgaaacaagggacgccuuuauaacgaaccucaucggcaacgacauaaucuugcuaaacgagaagguccuucccaaaagaucacugaucuacgaggaagucaugcuccaaaacgaacuaacccgggucaaauacaaggacaaguacggcaagacccacuuuuucgacuccgaacuucgccaggaaaucaucaauaaucucuucaagacaaacaauaaacgagucuccuccgccaugcuucucgacuaccuugaaaacuacacaaaucuccaggcagucgaaauagucagcggcauagagaaagguaaaucgcucaacagcacacucaagaccuacaacgaccugaagaccauauucuccgaggaacugcuggacucagaaauauaccagaaagaacucgaagagaucguaaaagucaucaccguauucgacgacaagaaaagcaucaaaaacuaccugaucaaauacuucgggcaucucgaauuucuaaacgaggaacgcaucaaccaauuaucgaaacuucgauacaccggcuggggccgcuauuccgcuaaacuacuucucgacauccgcgacgaagacacaggauucaacuuaaugcaguuccuccgaaacgaugacgagaaccguaaccugucgcagcuuaucuccgacucuacacucagcuucgauucagccaucaaaaccauccaaucgaaauccacggucgaagaugauguauucgacgaaauaaagaaacuagcaggcucuccggccauaaaacgaggcauccugaauaguauuaaaauaguagacgagcuaguccaaauaauuggcuacccaccccaaaacauugucaucgaaauggcgcgcgaaaauaugaccacugaggagggacagaagaaggccaaaacgaggaaaacaaaacucgaauccgcccucaagaacaucgaaaauucaguauuagagaacggcaaaguaccccacagcgacgagcaauuacaaucagagaaacucuaccuuuacuaccugcaaaacggcaaagacauguacucccuagacaagacaggcuccccaacuccgcuauaccgggaccaacuggaccaauacgagguagaccacaucauacccuacuccuuucucccaaucgauagcaucgauaacaaaguucugacacaccgggaaaacaaccaacgcaagcuaaacaacauccccgacaaagagaccgucgccaacaugaaaccauucugggagaaacuauacaacgccaaacuuaucucccaaaccaaguaccaacgccucaccaccucagaacguaccccagacggaguccucaccgaguccaugaaagccggauucaucgaacgacaacugguggaaacgcgccagaucaucaaacauguagcccgcauccucgacaaucguuuccucgacacgaaaaucaucgcgcucaagucccaacucaucacaaacuuucgaaacaccuuucacaucgccaaaauucgcgaacucaaugacuaccaccacgcacaugacgcauaccuggccgucgucgucggucaaacccugcuaaaggcuuaccccaagcuagcucccgaguugaucuacgggcaucacgcccacuucaaccgccacgaagagaacaaagcgacaauacggaaacaccuauauagcaacaucaugcgcuucuucaacaacccggacucaaagguaucaaaagacaucugggauuguaaccgagaccucccaauaauaaaagaggucaucuacaacucccaaguuaacuucgucaagcgaaccaugaucaagaaaggcgcuuucuacaaucaaaaccccguaggcaaauucaacaaacaaauagccgcaaacaaccgcuauccacuuaaaacgaaggugagcucccuagacaccucaaucuacggcgguuacggaccuaugaacucagcccucucgaucaucaucauagccgaacgcuucaaugaaaagaaaggaaaaaucgaaacagucaaagaguuccaugacauuuucauaaucgauuacaaaaaguucaacaacaauccauuccaauuccucaacgacaccagcgaaaacggcuuucugaagaaaaauaacaucaaccgaguacuggcauucuacggagucccgaaauacagccuuaugcagaaaaacgacggcacccggaugcuguucgaaagcaaaagcaaccuacacaaagccacccaauucaaacucacaaaaacacaaaaugaacuauucuuccacaugcgucgccuacuuaccaaauccaaccugauggaccucaaaucagaguccgccauuaaggaaucccaaaacuuuauccugaagcacaaggaggaauuugacaacauaucaaaccaacuguccgccuucucgcagaaaaugcugggcgacacuaccagccuccgcaacuuaauuaaaggauacaaugaacgcaaaaucaaagagaucgauucaucagaagaagucauuaaguacuucuacgauaauuucauaaagauguucagcuuuguaaagagcggagccccaaaggauauuaaugacuucuuuaacaacaaauacacagucgcacgaaugcgccccaagcccgacaaaaaguuucuaaacgccacccugauacaccaaucaauaaccggccuguacgagacgcggauugaucugucaaaacucggugaagacuga

SEQ ID NO: 6803 - RNA, 4263 nt, Artificial Sequence
  Cas9 variant
auggccaaguucaacaagaacuacuccaucggccuugacaucggcgugucaucagucggcuacgcagugguaacugacgacuaccgcgugccagcauucaaguucaaaguccuuggcaacaccgaaaaagagaaaaucaagaaaaaccucaucggcuccaccacauucgugcccgcccaaagcgcacaaggcacgcgcguauucagggucaacagacgcaggauagaccgccgcaaccacagaauagcauaccuccgugauaucuuccaaaaagaaaucgagaagguagacaagaacuucuaccggcgccucgaugaauccuuccgcguccuaggggacaagagcgaagaacuccaaauaaaacaacccuucuucggcgauaaagaacuugaaacugcguaccacaagaaauacccuaccaucuaucaucuaagaaaacaucuagcugacgcggacaaaaacucacccgucgccgacauccgugaggucuacauggcaauuucccacauccuaaaauaccgaggccacuuccuuacccuugaccggaucaauccaaacaacauaaacaugcagaacaguuggauugacuucauagaguccugucaagagguuuucgaucuggagauuucagacgaaucgaaaacaauagucgccaucuuuaaaucauccgacaacaggcaagaaaaaguuaagaaaauucucuccuacuuccagcaggagcuacucaaaaaggacaaauccaucuucaaacaguugcuucagcuccuauucggccucaagaccaaauucaaggacugcuucgagcuggaagaggagccagaccucaacuucagcaaggagaacuacgacgaaaaccuggaaaacuucuugggcucccucgaggaagacuucuccgacguauucgcaaaacucaagguacuccgggacacaauucuuuuguccgggaugcucacauacaccggaacaaccagggcacguuucucggcaaccauggucgaacgcuacgaggagcaccgaaaggaccuccagcgguucaaaucguucguaaaacaaaaccuuucugaacaggacuacuuagacauauuuggccgcaaaaccccgaacggcuucgacguagacaaagaaacgaaaggguacgucgguuauaucagcaacaagaugguccuaacuaacccacagaagcagaaaaccauccaacagaacuucuacgacuauaucucagggaagaucaccggaauagaaggcgcagaguacuuucucaacaaaauauccgacgggaccuuccugcgaaaacuacgcaccaccgacaacggggccguacccaaccaaauccaugcauacgaacuagagaaaaucaucgacaggcagggggaagacuaccccuuccuccuggaaaacaaagauaaacuacucagcauacucaccuucaagaucccauacuacguaggaccacucagcaaaggaaacaauucgcgcuucggauggaucaagcgcacaaucagccaagacauccuggacgauaacgaugaagacacccgcaacggaaaaauccgccccuggaacuaucagaagcucaucaauauggacgaaacccgcgacgcguucaucaccaaccucaucgggaacgacauaauccuucucaacgaaaaagucuuaccuaaacgcagucuaauauaugaagaagucaugcuccagaacgaauugacccgcguaaaauacaaggacaaguacgggaaaacccacuucuucgauagugaacuacgacaggagauaauaaacaaccucuucaaaacuaacaacaaacgcgugucgucggcaaugcuacuagacuaccuagaaaacuacacuaaccuccaagccguugaaaucgucagcggcauagaaaaaggcaaaucgcugaacagcacgcugaagacauauaacgaccugaagacgaucuuuagcgaggaacuguuagacagcgaaaucuaccagaaagaacuggaggaaaucguuaaggucaucacgguauuugaugacaagaaaucaauuaaaaacuaucuaaucaaauacuuugggcaccuagaauuucucaacgaggaacgaaucaaccaacuuagcaaacugcgcuauaccggguggggccgcuacagugcaaaacuacucuuagacauccgcgacgaggacacagguuucaaucuaaugcaguuccugagaaacgaugaugaaaacagaaaccuaucgcaacugaucuccgacucaacguuauccuucgacuccgcaaucaaaucgauccaaagcaagagcacaguggaggacgacguauucgacgaaaucaaaaagcucgccggcagccccgccauuaaacgcggcauccuaaauucgauaaaaaucgucgacgaacucguucagauaaucggguacccuccccaaaacaucguaauagaaauggcacgcgaaaacaugaccacugaagaaggccaaaagaaagccaaaacgcgcaaaaccaaacucgaguccgcccucaaaaacauagagaacaguguacucgaaaacggcaaagucccccacagcgacgaacaacuacaaagcgaaaaacuguaccuguacuaccuacaaaacggcaaagacauguacucccucgacaaaaccggaaguccaaccccacucuaccgcgaccaacucgaccaguaugaagucgaccacaucauacccuacucauucuugccaaucgacucaaucgauaauaaagugcuaacccauagagaaaacaaccaacgaaagcucaacaacaucccggauaaagagacagucgccaacaugaaaccguucugggaaaaacucuauaacgccaagcucauaucacaaacaaaguaucaacgacugaccaccagcgaacgcacuccggacggggugcuuaccgaauccaugaaagccgguuucauagaacgccagcucgucgaaacacgacaaauuaucaaacacguagcccggauacuagacaacagauuccuagacaccaaaaucauagcauuaaagucacagcuuauaacaaacuuccgcaauacguuccacauagcuaaaauccgggagcucaaugacuaucaccacgcgcaugacgcguaccuagccguggucgucggccagacacugcucaaggcauaccccaagcuagcacccgaacucaucuauggccaccacgcacacuucaaucggcacgaagaaaacaaggccacgauccggaaacaccuguauagcaacaucaugcgauucuucaacaacccugauucuaaggucagcaaagauaucugggacugcaaucgcgaucuccccauaaucaaagagguuaucuacaacucccaagucaacuuugucaaacgcacuaugauaaagaaaggcgcuuucuacaaccagaaccccguuggaaaauucaacaaacaaaucgcggcaaacaaccgguacccguugaaaacgaaggucucgagccuagauacaucgaucuacggcggcuauggcccuaugaacagcgcgcuuucuaucaucaucauagcagaacgcuucaaugagaaaaagggcaagaucgaaaccgucaaagaguuccacgacaucuucaucaucgacuacaagaaauucaacaauaacccguuccaguuccugaacgacacaucggaaaauggauuucuuaagaaaaauaacauaaaucgcguccuagcauucuacggagucccuaaauacagucuaaugcagaaaaacgacggcacuaggaugcuauucgaaagcaaaagcaaccuccacaaagccacucaauuuaaacucaccaaaacacaaaacgagcuguuuuuccacaugcggcgucugcuaaccaaaucaaacuuaauggaccuuaaaucagaaucagcaauaaaagagucccaaaacuuuauccuaaaacacaaggaggaauuugacaacaucucgaaccagcucuccgcguucucacagaaaaugcugggcgacaccacaagccuccgaaaccucauaaagggcuacaacgaacggaagaucaaggaaaucgacuccagcgaagaagucaucaaauacuuuuacgauaacuucaucaaaauguucucguuuguaaagagcggggccccgaaggacaucaaugacuucuucaacaacaaauacacgguugcgagaaugcgcccuaagccggacaagaaauuccuaaacgccacccucauacaccaauccauaaccgggcucuaugaaacccgaaucgaccuauccaaacuaggcgaagacuga

SEQ ID NO: 6804 - RNA, 4263 nt, Artificial Sequence
  Cas9 variant
auggcaaaauuuaacaaaaacuacagcaucggauuagacaucggcgucagcucagucggcuacgccgugguuacagaagacuaucgagucccggccuucaaguucaaaguccuaggcaauacggagaaagagaagauuaaaaagaaucugaucgguagcacaaccuucguccccgcucagucagcccagggcaccaggguguuccgagucaaccgacgccgaaucgaccgacgaaaccaccgcauagcauaccuacgcgacaucuuccaaaaggaaaucgaaaagaucgacaagaacuucuacagacgacuagacgagagcuucaggguucuaggcgacaagucagaagacauucaaauaaaacagcccuucuuugggaacaaggaacuggaaaccgcauaccacaagaaguauccaaccauauaucaccuccgaaaacacuuagcagacgcggacaaaaacucgccuguagccgauauucgggaagucuacaugguacucucccauauacuuaaauaccgcggacacuuccucacauuaggcaaaaucgacccaaacaacauaaacaugcagaacucauggauagacuucauugaaucaugccaagacgcauuugacuuagagaucuccgacgaauccaaaaccauugccgccauauucaagagcagcgagaauagacaagaaaaggucaagcagauccuauccuacuuccaacaagaacuccugaaaaaggacaaaagcauauuuaaacaacugcugcaacuucucuucggucuaaaaacaaaguucaaagauugcuucgagcucgaggaagaacccgaccuuaacuucuccaaggaaaacuaugacgagaaucucgaaaaccugcuaggcgcccucgaagaagacuucagcgaugucuucgcgaaacucaaaauucuacgcgacaccauacugcuaucaagcaugcucaccuacaccggcgcgacccacgccagguucucggccaccaugguagagagguacgaagaacaccgcaaagaccuacaacgcuucaagucauucguuaaacaaaaccucagcgagcaagacuaccucgacaucuucggacgcaagacaccgaccggcuucgacgucgacaaagagaccaaaggauacgucggauauaucucaaacaagaugguccucacgaacccacaaaaacagaagaccauccaacagaacuucuacgacuacaucucaggaaagaucaccgguauagagggcgcagaaugcuuucucaacaaaaucagcgacgguaccuuccucaggaaacuacggacaaccgacaacggcgcuauccccaaccaaauacacgcauacgagcucgagaaaauaaucgaacgccaagggcgagacuacccauuucuacuggagaauaaagacaaacuacuaaguauacucacguucaagauaccauacuacgucggcccgcuagccaagggaaacaacagccgcuucgccuggauaaaacggacgaccagccaagacguccucgacgacaacgacgaagacacgcgcaacggcaaaauccgcccguggaacuaccacaagcuaauaaacauggacgagacccgggacgccuuuaucaucaaccugaucggcaacgacaucauucuacucaacgaaaagguacuacccaaacgcucacugaucuaugaagaaguuaugcuacaaaacgagcucacacgggucaaauacaaagacaaauacgguaaaauacauuucuucaacagcgaacuccggcaggagaucaucaacaaccuauuuaaaaccaauucaaagagagucuccagcgcgaugcuccucuccuaccuagaaaacuucaccaaccuccaggcaguggaaauaguauccggcaucgagaaaggaaaaucccuaaauuccacacuaaaaaccuacaacgaccugaaaaccauauuuucggaggagcugcuagacucagaaaucuaccaaaaggaacuugaggaaauaaucaaaguaaucacggucuucgacgacaagaaaagcaucaaaaacuaccucacgaaauacuucggacaccuggaauuucugaacgaggaaaagaucaaccaacucucgaaacuccgauacacaggaugggggcgauacuccgggaaacuacugcuggguauccgcgacgaagacacuggcuucaaucuaaugcaauuccugcggaacgacgaugaaaaccgcaaccugacccaacuaaucucugacacaacccugagcuucgacuccgcaauuaaggccauccaauccaagagcaccgucgaagacgauguauucgaggaaaucaagaaccuagccggcucccccgcaaucaaacgcgggauccuaaacuccauaaaaaucguagacgagcuaguacagauaaucggauacccuccccaaaauaucaucaucgaaauggccagagaaaacaugaccacagaagaggggcaaaagaaagcaaaaacccgcaaaagcaaacucgagucggcacugaaaaacauagaagacucaguccuagaauccgggaaagugccccacuccgacgagcagcuccaauccgaaaaacuauaucuguauuaccuccaaaacggaaaagacauguauucccucgacaaaacaggaagccccacaccccucuaucgagaccagcucgaccaguacgaggucgaccacaucauccccuauucauuucuccccaucgauucaauagacaacaagguccugacccaccgcgaaaacaaccagagaaaacuuaacaacauaccagacaaagaaacagucgcaaacaugaaaccuuucugggaaaaacuuuacaacgccaagcugaucucccaaaccaaguaccagcgacucacaacgagcgaacgcaccccugacggcguucugaccgaaagcaugaaagccggcuucaucgagcgccagcucgucgagacccgacaaaucaucaagcacgucgcacgcauacucgauaacagauuuagcgacacaaagauaauaacccuuaaaucccagcuagucaccaacuuccggaacaccuuccacauagccaaaaucagagagcuaaacgacuaccaccacgcacacgacgcguacuuggccguggucgucggccaaacccuucuaaaggcuuauccgaagcucgcgccagaacucauauacggacaucacgcccacuucaaccggcacgaagagaacaaagcaacucuucgaaaacaccucuacagcaacaucaugcgauucuucaacaaccccgacagcaaaguauccaaagacauuugggacugcaaccgggaccugcccaucguaaaagauguaauauacaacucacaaauaaauuucgucaaacgcacaaugauuaagaaaggugccuucuacaaucaaaacccggucgggaaacuaaacaaacagaucgcugccaacaacagauacccauuaaaaaccaaagugucuucguuagacaccagcauuuauggaggcuacggaccuaugaacagcgcacugucgaucauaauaaucgccgaaagguucaaugagaaaaagggcaagauagagaccgugaaagaguuucaugacaucuucauuaucgacuacgagaaauuuaacaacaauccguuccaguuccugaacaacgugucagaggagggcuuccucaaaaagaacgacuuaaacagaguccuagcguucuacaggaucaguaaguacagcuuaaugcagaaaaucgacggcacacggaugcuauucgaaagcaagagcaaccuccauaaagucacccaguucaaacucacuaaaacccagaaugaacuauuuuuccauaugaagcgacuauugaccaaguccaaccucauggaccugaaaucagaaucagccauuaaggaaagccaaaacuucauccagacccaccagaacgaguucgacaacaucgcggaccgucuaucgaauuacagucagaaaaugcucggcgaaaccaagucgcuccaaaccuuaaucaacgguuacaaugaacgccccaucaaacaaaucgacaacaacgaagaaaccauacgauacuacuacgacaacuucauaaaaauguuuuccuucguuaaaaguggagccccaaaggacaucauaaacuucuucaaugacaaauauacaguuccccgaaugcgccccaaaccugacagaaaaaugcucgacgcaacccucauccaccaguccauaacugggcuauacgaaacccgcauagaccucuccaaacuuggcgaagacuga

SEQ ID NO: 6805 - RNA, 4263 nt, Artificial Sequence
  Cas9 variant
augagccgcaaaaacuacgucgacgacuacgcaaucagccucgacauuggcaacgcaucagucgguugguccgccuucacgccgaauuaucgacucguacgcgcaaaaggacacgaauugaucggagucagacucuucgacccagccgauacugcggagagccgaaggauggcacggacaacaagacggcgcuauucaagaaggcgauggcguuugaggcuccucgacgcccucuucgaccaagcacucagcgagauagacccgagcuuccuugcccgccgcaaauacucauggguccaccccgaugacgaaaacaacgccgacugcugguacgggaguguacuauucgacucgaaugagcaagauaaacgcuuuuacgaaaaguaccccacaauauaccacuuaagaaaagcgcucauggaggaugacucucaacacgacauacgggagaucuaccucgcuauccaccacauggugaaauacagaggaaacuuccugguggaaggcacucucgaaaguagcaaugccuucaaagaggacgaguugcucaaacuacugggccgcaucacgcgauacgagaugagcgagggagagcaaaacucagauauagagcaagacgaugagaacaagcucguagcccccgccaacggacagcucgcagacgcccugugcgcaacccgggggucccgcucgaugagaguugacaacgcccucgaggcccucagugccguaaacgaucuaagccgagaacagagagccaucguaaaggccauauucgcuggacucgaggggaacaagcucgaccucgccaaaauuuucguaagcaaagaauuuagcucggaaaacaagaaaaucuugggaauauacuucaacaaaagcgauuacgaagaaaaaugcguacagauagucgacucaggucuacuggacgacgaagaacgagaguuccuggaucgcaugcaaggccaguacaacgccauugcccuaaaacagcugcuaggaaggucaaccagcgugucagauagcaaaugcgcaagcuacgacgcccaccgcgccaauuggaaccugaucaaacugcaacuacgcaccaaggaaaacgagaaggacauaaaugaaaacuauggaauccuagugggcuggaagauagacuccgggcaacgcaaaucaguaagaggagaaagcgccuaugaaaacaugcgcaagaaagcgaacguauucuucaaaaagaugaucgaaacaucagaccuuucggagaccgacaaaaaccgccugauacacgacaucgaggaggacaaacuauuuccaauacagcgcgacuccgacaauggcguaauaccgcaucaacugcaccaaaacgagcucaagcaaaucauuaaaaagcaaggcaaauauuaccccuuccuguuggacgcguucgagaaagacggcaaacagaucaauaaaaucgaaggucuccugaccuuccgcguccccuacuucguuggcccacuggucguccccgaagacuuacaaaagagcgacaacagcgaaaaucacuggaugguccguaaaaagaaaggugagaucaccccauggaacuucgaugagaugguagacaaagacgcaagcgggcgaaaauuuaucgaaagacugguaggcacugacucauaccuacucggagaacccacgcuaccgaaaaacucccuauuguaccaggaguaugaagugcuaaacgaacucaacaacgugaggcuaucaguccgaaccggaaaccacuggaacgacaaacgaaggaugcgacucggccgcgaagagaaaacucuacuaugccaacgccuauucaugaagggccagacggucaccaagaggaccgccgaaaaccuguuaagaaaagaauacgggcguaccuacgaguuaaguggccuguccgacgaauccaaauuuacauccagucuauccaccuaugggaaaauguguagaauauucggcgaaaaauacguaaacgaacaccgugaccucauggagaaaaucguugaacuacaaacgguauucgaggauaaagagacauugcuccaccaacuccggcaacuagaaggcaucucggaagcagacugcgcacuucugguaaacacgcacuacaccggcuggggccggcuaucaagaaaacuacugaccacaaaagccggagagugcaagauauccgacgacuucgcuccccggaagcacuccauaaucgaaaucaugcgagccgaagaccgcaaucuaauggaaauaaucacagacaagcaacuuggcuucagcgacuggauugaacaggaaaaccuaggagccgaaaacggaagcagcuuaauggaaguggucgacgaccuccgaguaucaccgaaagugaaacgaggcaucauccaguccauacgauuaauagacgacauaagcaaggcaguugguaaacgcccaucacgcaucuuccucgaacuagcugacgacauacaaccauccggaagaacgaucagccgcaaaucgagacuccaggaccuguaccgcaacgcaaaucuaggaaaagaguucaagggaaucgcagacgaacucaacgcaugcuccgacaaagaccuacaagacgacagacuguuccuauacuacacgcaacugggaaaggacauguacacaggagaagaacucgaccuagacagacugagcuccgccuacgacaucgaccacaucauaccucaagcagucacacagaacgacagcauagacaacaggguccuaguagcaagagcagaaaaugcacgaaaaacagauagcuucacguacaugccccaaauagcagacagaaugcgaaacuucuggcaaaucuuacuggauaacgguuuaauaagccgagucaaauucgaaagacuaaccagacagaaugaguucagugaacgagaaaaagaaagauucguccaacgcucccuggucgaaacgcgccaaauaaugaagaauguggcaacccuaaugcggcagcgcuauggcaacagugccgcgguaauuggucuaaaugcggaacuaacaaaagaaaugcauagauaucucggcuucucccacaaaaacagagacauaaacgacuaccaccacgcacaggacgcacucuguguagggauagcgggccaguuugcggccaaccgcggguucuucgcagacggagaagugagcgacggcgcacagaacagcuacaaucaauaccuacgggacuauuuaaggggguaccgagaaaagcuaagcgccgaagacaggaaacaaggccgugcuuucggcuucaucguaggcucgaugagaucccaggacgaacaaaaacgcguaaacccucgcaccggcgaagucguguggagugaagaggacaaagacuaucuacgcaaggucaugaacuaccgaaaaaugcuugucacccagaaagugggagacgacuucggagccuuguacgaugaaacgcgauacgcagcgacggacccgaaaggcauaaaagggauacccuucgacggagcuaaacaagacaccucccucuacggcggcuuuaguucagcaaagcccgccuacgccguccucaucgaaagcaaaggcaagacacgccuagucaacguaaccaugcaagaguacucacuccucggggaccguccaagcgacgacgaacucagaaagguauuagccaagaaaaagagugaauacgccaaagcgaacauauugcuacggcaugugccaaaaaugcagcugauacgauacggaggcggacuaaugguaauuaaaagugccggggaacugaacaacgcacaacaacuauggcuacccuacgaagaauacugcuacuucgacgaucucagccagggcaaaggaucccucgaaaaagacgaccucaaaaagcuacuagacuccauccuggggucgguccaaugccuguaccccuggcaccgguucaccgaggaagaacuggcggacuuacacguagccuucgacaagcuccccgaagaugagaaaaagaauguaauaaccggaauagucuccgcacugcacgcggacgcuaaaaccgccaaccucaguaucgucggaaugacuggaucauggcgacgcaugaacaacaaaagcggcuacaccuucuccgacgaagacgaguuuauauuucaauccccaucaggccuauucgaaaagcggguaacaguaggagaacuaaagcgcaaggccaagaaggaagugaacuccaaguaccgaaccaacgagaagcggcuaccgacacuaagcggagcaucgcaaccguga

SEQ ID NO: 6806 - RNA, 4263 nt, Artificial Sequence
  Cas9 variant
auggccaagccaaaggauuacacgaucggacuagacauuggcacuaacucuguaggcuggguagucacugaugaucagaacaauauccuccggauaaaagguaaaaaggcgaucggggcgcgccuauucgccgaaggcaaagucgcggcagagcgcagaaguuuucgcaccacgaggagacgaauaagucgcagacgcuggcggauaaagcugcuagaagaacuauucgaugaggaaaucgcaaaagucgacccauccuucuucgcccgucuccacgaauccuggauaaguccaaaagacaaacggaaaagauacuccgcaauaguuuucccuaguccagaggaagacaagaaauuccacgagaguuaccccaccaucuaucaucuccgagacaaacuaaugaaggaugaccaaaagcacgacauacgcgaaaucuacaucgccguacaccaaaugauaaaagucaggggcaacuuccuacacgacgaaaguguagagacguaccggucagguaugagcucacucggugggcgcuccgagcgaaccauccuaaguguacaaacccuggaagaacuaaaugauuuguucgcggaaaaugaagggacggaagaagucgaauuaaacgucgcgucugccgaacaaaucaacgacauccuuacgggggaccaccuaaacgcggacagccaaaaagaaauaagcaaccugcugcuaccguccucguucccgucauucgacgacaaggcgaaagaaaaacaagucaagaaacugauuaauaauguagcaacaaacaucucaaaagcguggcucggcuacaaagcagacuucucaaccauccuaaaccuggcgaaagucgacaaagaccagaaaaagaucuucgcauucgcccuccaaggcggcgacgaagaggauaagguucaagaacucgaaagccuccucgaacaaagccaaacggacaucguagaccgccuaauugaaaucagacacgccaucguacugagcgaaauugugccggucggaaugacauuaagcgaggccaugauagacaaauacgaccaacacaaggaagaccuaauaacccugaaggccguaauccgcaacacaaaagacaagaagaaagcagccaaacugcaggcgauauaugaccuauacgugaauaaccgacacgccgaccuggccaaagccaugaaacuaacggguaucaagaaaagguccgaauuacuagaccccgaagaacucaagaaagccauaaguucccugcuggacgacagcccagaagccggugagauaaaacaacgccucgaggggaaaaccuuccuaccguugcaacguagcaacaacaacggcgucaucccaaaccagcuacaccaaguggaacuagaugaaauaauaaagaaacaaucaaaauauuacccauuccuagccgagaaaaaccccgacgaauccgaagaggcacagaagaaagcuccgaccaaacucgacgcccuacucaccuuuagaguaccguacuacguaggcccaaugaucaccaaagaggaacaagaagcacaagacggucauucguucgccuggaugguucgacgcgacccccaagaccacgaagcaaucacaccuuggaacuucgaaaagaaaguagacaaaauggcuagcgccacccaguucauaaaacgaaugaccacaaaagacacguaccuccugggagaggacguacuccccgcaagcagccuaaaauaccaacucuucaccguccucaacgaacucaacaaccugcgcgucaauggcaagaaacucacgucggacgaaaaagaacaggugauagaaggacuguucaagaaacagaaaaccgugaaagcugacaaauucgucaaauacuggcaagccauacacauaggcgcagacauaaaagucaaaggacuuagugacccuagcaaauucaacaguacgaugucgaccuacaucgacuucaaaaagauuuuuggcgaccaacucaacgacgcaaacagacaaaacgauuucgagaaaaucaucgaauacagcacaaucuucgaagaccgaaagauccuagaagacaaacuucgagccgacuucgcguggcucagcgaagaacaaaucaagcaacugugucggcuccggcuacagggauggggacgccucagcgacaaacuucucacccggcucaccgaugccgacgggcaaaacguccuggaacgacuauggaacuccaaugauaacuuuguccaaauagucucugauccaaacauaaaagccaaaaucgagcaggagaaccagaaacugcugcgggauggccagucggacgacgccgucgaauccauucuagacgacgccuacaccucaccacaaaacaaaaaggcaauccgacagguaaugcgggucgugcacgauauuguaaaagcgugcgacggcaacguaccggccaaguucgccaucgaauuugcucgcucacaagaagacgacccgaaacgaacaaccgcacggguaaaccagaugcagaaaauauacgaccaaaucagcgacgaagucgucagccaaggcgucaaagaacaacuaucaggcaugaagagucucaaagaccgcuacuaccuguacuucaugcaagggggaagagacgccuacaccggcgcaaaacucaacauagaccgacucagugacuacgauaucgaccacaucaugccucagagcuuuguaaaagacgacucccuagacaaccgcguccucguagcacgggccgucaacaaccaaaagagugacaagguccccgcauuccuauucgggaacaagguggucgcggaccuagggaucacaguccgcgagaugugggacaaauggcaaaaacucgguaugauaucaaaaaggaagcuaucuaaccuccucaccgaccccgacgcgcugacugaguaccgagcccaaggauucauacgccgccaauuggucgagaccucacaaguaauaaaacugaccgccacgauacuccaaagcgaguucccagacaguaaaaucauagaaguccccgcaaaauacaacagcauaguccgcaaacaguucgaccuauacaaaucucgagaaguuaacgauuuucaccaugccaucgacgcguaucuuucaacgaucgucggaaacuaucucuaccaaguguaccccaacuugagacgcauguuuguauauggcgaguucaagaaauucagcucaaacgccgaagaaagcgcccacgacauggcuagaagaguaaaauccaugaacuuucuagaugaccuccuccgaggcacacacggagacaacaucuacugccgcucgaccggagagaucguguucaacagaaacgacauaaucucgaaacucaaacaagcauacuccuucaagcagaugcucguuacacaagaagucuucacccgcaaaagcgcucuauucgaccaaacuguauacccauccccggagagggacucaaagaaacguagcggccuaaucccccguaagaaaggaauggacaccgaaaucuacgggggcuacuccgguaacaaagacgccuacuucguccuagccgaagccgugaaagaaaaagggcacacucuccagauaguuggagucccaauacgggcucucaacacccucaaaaacagcgcaaacuacucggagaagcuauuagaaauaaucaagccccaagucauguuuaacaagaaaaaugggaaaccgaagaaaggugucaacgauguacgaauccugauggauaacauuccuuacagacaaccgguacucgaaggcggcgcccuauacaugcucgggaguagcaccuacaaauacagccucaaacaaaucacgcugagccaggagucgaugaaauacauccucgacuacaucgacgaccccuccuucaacaaacacauuaugguaaacauagaucaccaggacgaaaagaaaugccuacuauccguauacgacgaaauacucgacaaaauggauaaauaccugccguuauucgacaucaacggcuuccgcaagaaacuacacgacggccgcgagaaauucgucaaacuacccguagagaaacaagccgaaguaguuaaagacauucuccgcggccuucaugcaaacagcgaaaugacaaagcccagcgaccuaggcuugacgaccgcgcucggauucaugcaagccccagacggaauaaaaaucucugacgacgccgucuucaucuaccaaagucccaccgggcuguucgaaaggcgcguuaaaguuagugaccuacucaaauga

SEQ ID NO: 6807 - RNA, 4266 nt, Artificial Sequence
  Cas9 variant
augacaaaauucaauaaaaacuacucaaucggguuggacauaggagucagcucagucggguacgccguugucacugaggacuaccgagucccagccuucaaguucaaagugcugggcaacacugaaaaagagaagaucaaaaagaaccucaucggcagcacaaccuucgucucagcccagcccgccaaaggcacccgcguauuccgcgucaaucgacgaagaauagaccgacgaaaccaucgcaucaccuaccuaagagauauauuccagaaggaaaucgaaaaagucgacaaaaacuucuaccgucgacucgacgagagcuucagagugcucggcgacaagagcgaggaccuccaaaucaaacagcccuuuuucggagacaaagaacucgaaacagccuaccacaagaaauaccccaccauuuaccaccuacgcaagcaucucgcggacgcggacaaaaauagccccgucgcggacauccgcgaaguuuacauggccauaucacacauccuaaaauauaggggucauuuccucacacucgacaagaucaacccgaauaacauaaacaugcaaaacucguggauagacuucaucgaaucaugccaagagguauucgacuuagagauauccgacgagagcaaaaacaucgcggacaucuucaagucaucagaaaaccgccaggaaaaagucaagaaaauccuucccuauuuccaacaagaacuacugaagaaagacaaauccauuuucaaacagcugcuacagcuucucuuuggccuaaaaaccaaguucaaagacugcuucgagcucgaagaggaacccgaccuaaacuucagcaaagagaacuacgaugagaaccuugaaaauuuccucggcucacucgaagaggacuucuccgacgucuucgccaaacuaaaaguccuuagagacaccauccuacuauccggaaugcuuaccuacacaggagcuacccacgcccgguucucggcaacgaugguagaaagauacgaggagcaccgcaaagaucuccaacgguucaaauucuucauaaagcaaaaccucagcgaacaggacuacuuggacaucuucgggcgcaagacgcaaaacggguuugacgucgacaaagagaccaaaggguacgucggcuacaucaccaacaagaugguccucacuaacccacaaaaacagaagaccauacagcaaaacuuuuacgacuacaucuccggaaaaauuacuggcaucgagggcgccgaauacuuccucaauaaaaucuccgacggcaccuuccuucggaagcuccgaaccuccgacaacggcgccauaccaaaccaaauccacgccuacgaacuugagaaaauaaucgaacggcaaggaaaggacuacccguuccuccucgaaaauaaagauaaacugcucucaauccucacauucaagauacccuacuacgugggcccgcucgccaaagguucaaacagccguuucgccuggaucaagcgcgccacgucaucagacauccucgacgacaacgacgaagacacgagaaacgggaaaauacgacccuggaacuaccaaaaacugauuaacauggacgaaacccgugacgcuuucauaaccaaccucauuggcaacgacauuauuuugcucaacgaaaaaguccuaccaaaacgcucccuaaucuacgaagaagugaugcuccaaaacgaacuaacccgggucaaauauaaagacaaauacgguaaggcccacuucuucgauagcgagcuccgacaaaacaucaucaauggacuauucaaaaacaacucuaaacgcgucaacgcaaaaucccuaaucaaauaccucuccgauaaccacaaggaccucaacgccauagaaaucgucuccgguguagaaaaaggaaaauccuucaacucgacgcuaaaaacuuacaacgaccuaaaaacaauuuucuccgaggaauuacucgacuccgaaaucuaccaaaaggaacuugaagagauaaucaaagucaucaccgucuucgacgacaagaaauccaucaaaaacuaccucacuaaguucuucggccaccuggaaaucuuagacgaggagaaaauaaaucaacucaguaaacuccgcuacuccggcuggggccguuacucagcuaaacucuuguuggauauaagagacgaagacacaggcuucaauuugcugcaguuccuccgaaacgacgaagaaaaccgcaaucuaaccaaguuaauaucggacaacacacucagcuucgaaccgaaaaucaaagacauccaaaguaagagcaccaucgaagaugacaucuucgaugaaauaaagaaacucgccggaucgccagccaucaaacgagggauucucaacagcaucaaaauaguagacgaacucguccagaucaucggcuacccaccccacaacauaguuauagaaauggcgagagaaaacaugaccacagaagagggucagaaaaaggccaaaacgcguaaaacaaaacuagaaucggcguuaaagaacaucgagaacucccuacucgaaaaugggaaagucccccacucggacgagcaguuacagagugaaaaacucuaccucuacuaccuccagaauggcaaggacauguacacccucgacaaaacgggcucccccgcuccccuguaccucgaccaacuggaccaauacgagguagaucacaucaucccauacagcuuccuaccaaucgacucgauugacaacaaaguccucacgcaucgggaaaacaaccaacagaaacucaacaacauaccggacaaagagacggucgccaacaugaaaccguucugggaaaaacucuacaacgcaaaacucauaucccaaaccaaguaccaaagauugaccacgagugagcgcacucccgacggcgugcucacagaaagcaugaaagcgggguucaucgaaagacaacucguagaaacucgacaaaucauaaaacacguagcacgcauccucgauaaccgauucucggauaccaaaauuauuacucugaaaagccagcugaucaccaauuuccgcaacacuuuccacaucgcgaaaauacgcgaacucaaugacuaucaccacgcacacgacgccuaucucgccguagucguaggacagacccuacucaaggucuaccccaaacucgcgccugagcuaauuuacggccaccacgcccacuuuaaccgacaugaagagaacaaagccacgcuacguaagcaccucuacuccaacaucaugcguuucuucaauaaccccgacuccaaggucucgaaagauaucugggacugcaaccgagaccugccgaucaucaaagacgugaucuacaacucgcaaaucaacuucguaaaacggaccaugaucaaaaagggcgcguucuacaaccagaaccccgucgguaaauucaacaaacagcuagccgccaacaaccgguacccccuuaagaccaaagcccuaugccucgacacaucgaucuacggcggauacggcccuaugaacucagcccucuccaucauaaucauagcggagcgcuuuaaugaaaagaaaggcaaaauagaaaccguaaaagaguuccaugacauuuucauaaucgacuaugaaaaauucaacaacaaucccuuccaauuccuuaacgacacgagugaaaacggauuccuuaagaaaaacaacauaaaccgaguccuaggcuucuaccggauuccaaaauacucccucaugcagaaaaucgacggcacgcgaauguuauucgaaagcaaaagcaaccuccauaaggccacacaauucaagcuaacuaagacccagaaugaacucuucuuccacaugaagcgcuugcuaacaaagagcaaccuaauggaccugaaaagcaaaagcgccaucaaagaaucccaaaacuucauacuaaagcacaaagaagaguucgacaacaucuccaaccaacucagcgcguuuucccaaaagaugcuaggcaauacuacgucccuaaagaaccucauaaaaggauauaacgaacgaaaaauaaaggaaaucgauauccgggacgaaacgauuaaauacuucuaugacaacuucaucaagauguuuuccuucguuaaaagcggcgccccuaaagacaucaacgacuucuuugacaacaaaugcaccguugcgcgaaugagaccaaagccugacaagaaacuucucaacgcaacccugauccaccaauccauaaccgggcuguaugaaacacguauagaccuauccaaacugggggaagacuga

SEQ ID NO: 6808 - RNA, 4266 nt, Artificial Sequence
  Cas9 variant
augaagaaaauacuaggccucgaucuuggcccaaacagcauaggcugggcccuaguaaacgaagccgagaacgaaaacgaaaaaucuagcaucauaaagauaggcucccgcgucauccauuacggagauaaccuagugaaaguugacaaaucggggaagaucagcgccagcaugacgccggaggaagacuucagcuccgggaaggggcucagucccaacgcaggaaggacgaaacaacgcagcgcccgacgaaaucuccagcgguacaaacagagacggaacaaccucauugaaauacucaaagcgcacucacuuaucgacaacaauuucauuuucagcgaggaaggaaacgagaccacauucaagaccuacaagaaccgcgcccuagcagcgacaaacgaaauaucguuagaggacuucauuaaaguacuguucaugaucaacaagaaacggggguacaaaucaagccgaaaagccaaaggagacgaagacggccagcuaauugacggcauggccauugcuauccagcuuuacgagcacaaucagaccccgggacaguucguuuacaaccuccucaaaaacggaaagaaaaacaucccagacuucuacaggagcgaccuacagaccgaguucgaccgcauauggaacuuccaaaaagccuuccaccaagagagcuugucugacggcauaugcgaaaagcuagucggccaaaagaaaaacgucacuagcgccauacucuucaaagaguucaaaaucgaaagccucgagaucaagggaaaaugggacgagaagcgcuucuucagguaugaacugagaaacaaagccguacaacaggaacuaaaacucaacgaaaucgcagaaugccucgucgaaaucaauggcgaaauaucaaacagcuccggguaccucggggccauaagcgaccgaucgaaggagcucgucuuccaaaagauuacagugggccaguaucucuacaaacagaucgcggcaaaccccaacacgucuuugaagaaacaaauauucuaccgccaggacuaccuggacgaguucaacacccucugggaaacgcaagccaaauaccacaaagaacucaccgacgagcuuaaaacccagaucagagacgucauaauauucuaccaaaggcgucuaaagucgcaaaaagggcucauuagcuucugcgaguucgaaucgaaacagaucgagguuuucgucgacgggaaaaagagcauaaagacccgcgggaugcgggucauuccaaagucuucaccccuguuucaagaguucaaaauauggcagauccuaaacaauauagaaaucacagaccucaaaacgaaagaguccagagagcuaacagacgacgaacgccaacuccuguuugaggaacucaacauacggcccaaaaucuccaagaaagaggcccuaaagauucucacggaaaaaccugcucaauacgaccugaacuacaaagauauagagggcaacaaaacgaacgccaaauucuacgaggcuuacaacaagauaauccaccuguccggacacgacgaaaucgacuucaccgacaaaacaucggacaucaacgaguaucuaaagcaaaucuucagucuccuuggcauaaaaccagaaauccucgacuucgauucaucccuuaaagacgaagacuucgaaaaacaguuacacuuccaacucuggcaccuguuguacucauucgaaggcgacaauaccaaaaccggagacgaaaaacuacuccaaaagcuaaacaccaaguucggguucccagucgaauacgccaaagugaucagcaacauagcccuaccggacgacuauggaucgcucucagcgaaggcaauccgaaaaauccuuccgcaucuaaaagacggguuuucguacggcggcagaaagagcaggccggacgaacccagcgcaugcgaauacgcgggguaccgccauucaaaggcaucccuaaccaaggacgaaaaagagaacaagaccuauaaagauaagcuagaaauacuacccaaaaacucacuucguaaccccauaguggagaaaauacuaaaccaaacgauuaaugucgucaaugcagucauuggugacuacgggaagcccgacgaaauccggcucgaacuagcgcgggagcugaagaagagugccgaggaacggcaggacgccacagacuccauuucaaaagcaacugcuaaacacgaaaaauaccgaaaagucuuacaaaccgaguucgggcucaaacacaucagucgcaacgaccuaauccgauacaagcuguaccuugaacugaaaaacaacgguuucaaaacccuauacuccgauaccuacaucgcgccguacgaaauuuucagcaaaaaguuugacaucgaacauauccuccccaaagcaaaacucuucgaugacucuuucucaaacaaaacgcuagaacuaaaguccgucaaccugaagaaaggcgacaugacggcauacgacuucguuaaagaggaguacgggacagaggggcuagcuaaauacgagcaaagaguacaagaccuauuccugaauaagaaacguaacgaggaccuugaccaagaaaacgaaucccgaauaacagacgagaaaaucucgaaaacgaaacgcgacaaacuucucaugccagaaaauaaaauccccaccggcuucaucgaccgcgaacugagagacagccaauacauagcgaagaaagccaaaaccaugauggaggacaucugcaaagacguggucacaaccaccggaucgguuacagaucgucugcgagaagacuggcagcucauagacaucaugcaggaacuaaacuggcccaaauacgcagcgcugggauuaacggaagaguucacaaaugaagaaggcaacguaauccgaaaaaucaaagauuggaccaaaaggaacgaccaccgacaccacgcaauggacgcgauaacaauagcguucacaaaacguagccacauacaauaccuaaacaaucucagugcacggagcgacaaauccagcuccaucuacggcaucgaacaaaaggaacuauaucgugacaaaaacaauaaacuaagauuugccccacccauccccaucaacgaauuucgcgccgaggccaagaugcaacucgaaaauacacuaauuagcauaaaggcccaaaauaaggucgucacgaaaaauaaaaauaagaucucggggcaaaagaaacugcaagaaacacuuacaccccggggacaacuccaucuagaaaccaucuacggcaaaauaaaucaauaucagaccgcggaaauaaaagucggagggacgcuagacagugaacugauaaacaaagucgcgaacaagaaaaccagagaagcacuccugaaccgucucgcagaguucggaaacgaccccaaaaaggcuuucacagucaaaaacacaauagacaaaaaccccaucuaucuggacaaacaccaauccuacaaaauccccgagaaagucaaaaucguguggcaagaaccagucuacaccauacgcaaaucaauaacaccggaccugaaacucgacaagauaaucgaccccaagaucaaagcucugcucgagagccgccuuaaagagugcaauggagacgcaaaacucgccuucaguaaccuagccgagaaucccauuuggcucaacaaagaaaaagggauccaaaucaaacgugucacgaucaccgguaucucaaacgccgcgucacuacacgacaagaaagaucucaacgggaaaccuauacuggaugaaaaaggaaacaaaauauccguugacuucgugaacacaggaaacaaccaccacguggccaucuacaaagacgaaaauggaaaccuccacgacaaugucguuacauuuuucgaagcuguagaaagagucaaccaaaaccugcccguaguagacaaauuauucaaacagaaagaaggguggcaauuccuauucaccaugaagcaaaacgaguacuucguguuucccaacgagaucacagccuucaacccaaaugaguucgaccuccugaacccggacaacuacuaccucauaucccccaaucucuuccguguccaaacaaugagcaaagucauguacggcaacaacacccuccgcgacuacaaguucaggcaccaccuugaaacgacacuccaggacaucaaggaauugcgagacauaguauucaaacaauucaaaagccuguccauauucgacaagauagucaaaguccguaucaaccaccucggcaagaucgucaaaacaggggaauacuga

SEQ ID NO: 6809 - RNA, 4266 nt, Artificial Sequence
  Cas9 variant
augaaggacauacuugggcuagaccuagguacaaacucaaucgguugggcugucgucaaagaagcccaaaacgacaaugagcaaagcgagauaguagacgucggcguccgagucaacccgcucacaacagaugaaaagacgaauuucgaaaaaggcaaacccauaagcacaaacgcugaccgcacacuaaagcgcuccgcacgcaggaaucuccaacgcuacaaacuccgacgaaaggaacugauagaacuacuaaaagaacaccaacucaucuccacugacacaauccucaccgaaaauggaaaagggaccacauuccaaacgcuagaacuccgcgcgaagucggccaaagagaaaauaagccuggaagaacuggcacgcguuuuccucaccaucaauaagaaacgcggcuacaaaucgagccggaaagccaaaaacgaggacgaagggcagcugauugauggcauggaaaucgcaaagcggcuauacgaagaaaaccucacaacaggucaacucucccuucagcugcugaaagaagguaagaaaucgcuaccagacuauuacagaucugacuuacaauucgagcucgacaagguauggaacuuccaaaaacaguuucacagccacauccugacagacgaguucuacgcacaacugaagggcaaaggacaacgugccacaucagcucuguuccuggcaaaauaccagaucuacaccgcggaaaacaaagguucccgggaagacaaaaagcuccaggcauaccaauggagagucgacgcccugagcaaagaauugacccgcgaacagcuugcauucgucauaaccgaaaucaacaacaaccucaacaacagcagcggcuaccuaggcgccaucucagacaggagcaaagaacuauauuucaacaacgaaacaguaggggaauaccucuggaaacagaucgccgcgaauccgcacacaucacugaaaaaccagguguucuaccggcaggacuaccuagaugaguucgaacaaauauggaaaacacaaagugccuuuuaccccgaaauccucacagaaagccugaagaaagaacuacgagacguggugauauuuuaccaacgcaaacucaaaagucagaaaagccuaguuuccuucugcgaguuugaaaacaaagaaauagaaauaaagaaagaagacggaacauccaccaagaaagucaucggccugaaaguggcaccaaaaagcagcccgcuuuuccaagaguucaaaaucuggcaaaaccucaacaacgucuuaauccgcaagaaagggagcaaaacgaagaaagccgccaaaaaccaacaagcuguacucuucgaggaggagaaaaccauuagugagcuugaccuggaggcuaaacaggcacucuucaacgagcucaaccugaaaggaaaccucaaagcagauuacugcuuggaaauccucggcuacucaccaaaagaaugggagaugaauuacagcgugcucgaagggaacaggaccaacaaagcccuauacgaagccuaucugaaaauaacggaccucgagggauacgacgccaagaaccaucugaagguaaagcucaacaaggacgaagucgagcucgacgacuuaaaagucccggcgagcgagauaaaagauaugguccaggccauauucaaagaagccggcauaaacaccgacauccuccacuucaacgccgagcucgacgggaaagacuucgagaaccaggcaagcuaccaguuauggcaccuguuauacucguacgaaggggacgacuccaaaucggggaacgaacuccuauacaaacugcuggaaacuaaauucggcuucaagaaggaauacgcccaaauccuugccaacgucucccugucagacgacuacggcuccuuauccacaaaagcaaugcgaaaaauccacccguacauaaaggagaacaaauuuagcacggcaugcgaguuagcaggauaccggcacucgaagcacucccucacaaaggaagagaacgacaaccgcguacuacgagacucccuggagguucucaaaaagaacucccuccgacaacccgucguagaaaagauacucaaccaaaugaucaaucuggugaacgcacuacugaaaaaguaccgcaccgagaacccgaacuucaaauucgacgaaauaaggauagaauuagcccgcgaacuuaagaaaaacgcagaggagcgagcuaacaugaccgcaaacaucaauaaagcuaaaaccgaacaugagaaaaucauaaaaauccugaagaacgaguucggacuccccaaccccacacggaacgacauaauaagauaccgcuuguaugaagaacucaaagcaaacggguacaaagaccuguauaccaacauaaaaaucccccaagagaagcucuuuacaaaagagauugacaucgaacacaucaucccuaaaucccgagucuucgaugauucauucucgaacaaaacccuuucauuccggaagacgaaucuagacaaaggggaacgaacggccuucgacuacauggaaucaaaguucggcgccgauaagcucgaagaauacguagcacgaguagaggacuuauacaagaacaacaucauaagcaaagccaaguaucaaaaauuacugaagaaagaaucagaaauuggagacggguucgucgaacgagaccuuagggaaacccaauacauagccaagaaggcaaaagaaauacuucuacaaauuacacccaacguucuauccaccagcggcgguauaaccgaccgccuccgggaagacugggaccucaucaacgugaugaaagagcuaaaccuaccgaaauaccgagcccucggccuuaccgaaauggaggaccgaaaguauggccaacaagucgaggucaucaucgauuggacaaagcgcaacgaccaccggcaucaugccauggacgcgcucaccgucgcauuuacgaaacacaaccacauccaguaccucaacuaccucaaugcgcgaaagaacgaaaaacacaaagagcacaguaacaucaugggcauucaacaacuagaaaccauaaaaguaacggacaaaaacggaaacgagaagcgaguauucaaagcgcccaugccaaauuuccgacagguaaccaaagcauucuuagaaaauauacucauaagccacaaagcgaaaaacaaaguagucacaaagaacaaaaacaaaguagcagggucgaacaaaguacaggaaguccugaccccgcgaggccaacuacacaaagaaacagucuacggcaaguaucaguacuacgugcaaaaagaagagaaaaucggggguaaguucgaucucgaaacgauaaagaaaguagccaacccccuguaccagagccugcucaaaaagcgacuggaagagaacgggggcgaccccaagaaagcauuuaccggcaaaaacucccucgccaaaaacccaaucuaccucgaugacgcgcagaccgaacaacuccccgagaaagucaaauugguuuggcuagaaaacagcuucuccauacgcaaagacaucacgcccgagaacuucaaagacgaaaaacucaucgacaaaauccuagacgaaggcgugaagaggauucuaaaagaaagacuacagucauucggcaaugacgccaagaaggccuuuagcgacuuagagaaaaaccccauuugguuaaacaaagaaaaagggaucacaauaaagcgcgucacgauuucaggcgucgccaacgcagaaccccugcauaccaaaaaggaccaccugggcaaggaaauacuugacaaagagggaaaaccgaucccaguagauuucaucucaacaggcagcaaccaccacguggcaguguaccgcgacgagaagggcaaccugcaagagaaaguaguaucggucuucgaagcuguugucagggcaaaccagggacucccuaucaucgacaagacauacaaccaacaccucggcugggaguuccuauucaccaugaaacaaaaugaaauguucgucuucccaaacgaguccaccggauucaacccgaacgauauagaucuccucgauccaaagaacaaacgaauaauuucgcccaaccuauuccgcguccaaaaacucgcgacuggcgacuacugguuccgacaccaccucgagacaacagucgagacaaagagcgcaaccaaggacaugacguauaaacgccuaucccuaaaccacaucaaaaacauaaucaagguaagaaucucacaccuaggggacaucgucuccgucggggaguacuga

SEQ ID NO: 6810 - RNA, 4275 nt, Artificial Sequence
  Cas9 variant
augaagcgaauccugggauuagacuuggggacaaacucgaucggcugggcccuagucaacgaggcagaaaccgacgaggaggucuccagcaucauacgacucggcguacguguaaacccccuaacaguugacgagacgcagaacuucgaaaaagggaaaagcaucacgacaaaugcagaaaggacgcuaaaacgguccaugcgaaggaacuuacaaagauauaaacucaggcgcgacgcgcugguagaguuccuaaaagaacuaggauucaucacagacgaaacuauccuaucagaacaggggaacaggaccacguucgaaaccugccgccuccgcgcaaaagccgccgaggaagagauaagucucgaggagcuauccagaguccuacucaugaucaacaagaaacgggguuacaagucuucccggaaggugaaaaaggaagaagacggaguacuuaucgacggaauggagauagcgaagaaacuguacgaggaagaccuuacaccaggacagcuaugcucacaacuacucgagagcggaaagaaagugcucccggacuucuaccgaagcgaccugcaggaagaacucgaccggauauggagcguacaaaagcaguuccacccagacguauucugcgacgcggcgaaggaagagauaaaagguaagaaucgcucccaaacaugggcgauccuagcaaacuacuucgucuggaaggaagaaguaguuggguggaacgacagagaggccaaaaacgagaccauagaaaaagaaugcaaacuggucgggcugaagagaacaacgaaagguuacgaacucaagaaagaaaacuaucgcuggcgggcacaagcacuuacagagcaauugggacuugaagaaauagcagucguccuacaggaaauuaacggacaaaucaaugcaucaagcggcuaucugggcgcgauaagcgacagauccaaaguacuauacuucaaccaccagaccgugggccaauaccaaauggcggaacucgacaaaaacccgcaugcgucacuuagaaacauggucuucuaccgucaggauuaucuggacgaguucgaccggaucugggaaaagcaggcagaguuccacaaggaauuaacagcggaacugaagaaagaaaucagggauaugaucaucuucuaccaacgacgucugaagagucaaaagggccugauuucauucugcgaauuugaaaggcucgaaaucgucguagagaaagacggcaagaaacaaacaaagguuaucggaugcaaagugauaccacgaagccacccacucuuccaggaguucaaggucuggcaaacccucaacgacauaaaaguccuaggucgagaaaagaagcgcaacgcccuuucagcaucagaaucccgagccuuguaccccgaagaaaaagagauccuggcgcgcgaacuagccaucaaagagaacaugaagaaagccgauguccugaaacuacucuucgaaaacccccaagaacuagaccuaaacuucaaacaaauagacggcaacagaacgggauucucacucuucucagcuuacaguaaaaugaucgagaaauacgguuacgaaccccuggacuucaaaaagccagcggacgaaaucaucggacagcugcgaaccauauucaccgaccuaggguggaacaccaaccuauucaccaucgaccucaccaaggaaggaaaagaacucgagaugcaacccuacuucagacuguggcaccuacucuauaguuucgaaggcgacaacacgagcacgggaaacggaaagcucauagaaaagauaaugcaacucugcgggguagaaaaggaauacgcgguugaacucgccagcuugagcuuccaggacgacuacggaucgcuuagcgcaaaggcgaucaaaagaauccuuccauaccuuaaagaagggaaccuauacgauguggcaugcgaauacgccggguauagacacucgaaaagcagccuaacaaaggaagagaucgagaacaaaguccucaagggaaagcucgaaguccuuccgaagaacaguuuacgaaacccaguagucgagaaaauccugagucagauggucaacguaaucaacaccaucauagacaccuacggcaaaccggacgaaauacgaguggaacuagcgcgagagcuaaagaaaagcgcaaaagagcgggaggagcugaccaaagcgaucgcaaagaguacaagagaacaugaagaaauacgcaagcuccuccaggacgaguucggcaugaugaacguaagcagaaacgacauuauaagauacaagcucuacgaagaacugaaagacaacggguacaagacgcuauacuccaaccaguacauaccuaaagagaaaaucuuuuccaaggaaaucgacaucgaacacaucaucccacaaucccguuuauuugacgacucacucuccaacaagacccucgaauacaaagcaaucaacaucgaaaaagguaauaagaccgcauacgacuucgucaaagaaaaauacggagaagaaggacuccagcaauacauaaacagaugcgaaagccucuucaacgacaaaaaggccaagcuaagaaaacugaaaauggaacagaaggacauccccgacggcuucaucgacagagaucuccgcaacacacaauacauagcgaagaaagcgcuagccaugcugaacgaaauaugcagaagagucgucgcgaccaccggcucaaucacggaccaacuaagagaagacuggcagcucgucgacguaaugaaagaacucaaccucccuaaauacgaggcgcucggcuucgucgagaccuacgaggacaaagacggaagaaaaauaaaacgaauaaaggacuggaccaagcgcaacgaccaccgccaccacgccauggacgcucuaaccguagccuuuacaaaagacgcuuucauccaguacuucaacaacaaaaaugcagcucaagacuccggcaaucguaaccacaccaacauaauaggcaucaagacacgcuacuucgacaaggguagagcccugcccccgaucccccucgagcaauuccggauugaagcuaaacaacaccuggaaaaacuacucguaagcaucaaagccaaaaacaaagucgugacgguuaacgucaacagaacaaagaagcgcaaaggggagaacacuaaaauccagcagacaccaagaggccaauugcaccuggaaaccguauacgguucacacaagcaauacgugaccaaaaucgaaaagguaaacgccuccuucgacgccgcaaaaauagccacggucucaaagcgcgcguaccgaaacgcucugcugaagcgccuagaaaccuucgguaacgacccaaagaaagccuucacagguaaaaacgcacuggagaaaaacccacuauacgcggauaaauaccagaccauaaggguucccgaaaagguccagaccgucgaguucgaaaccauauauaccauccgaaaaccgguggaccccgcgcucaacguggacaaagucgucgacguaaaaguccgcgccauccuggaaagacgacucaaggaauacggcggagaccccaaaaaggccuucgucaauuucugggaaaacccaaucuggcuaaacaaggaaaaaggaauuagcaucaagagggucaguauccgcggcauuaacaacgcacagagcauccacgucaaaaaggacaaaaacggcaacccaauaugggacgaaaacggcaaacagauccccguugacuucgucaacacggggaauaaccaccacgucgccauauacagaaaacccguccuggacaagaaaggacaagucacauucgacgaagacggaaaccugauguacgaacuagacgaaguagucguaccauuuuucgaggcgguaacgcgggccaacuuagggcugcccaucauagacaaagacuacaggaaauccgaaggauggcaauuccucuucuccaugaaacaaaacgaauacuucguguuucccaaugagaaaaccggguucaacccgaaagaagucgaccuccugaaccccgacaacuacgcaaugaucucaccaaaccuauuccguguccaaaccaugaguaaaguaauguacggaaacaacgugguaagagacuacaaguuccggcaccaucuggagaccacgguaaaagacaugaaggagcuaaaagacauagccuacaaacaauauaaaacacugagcuuuggcaacucagucgucaaaauaaggauaaaccacaucggccagauagucagcgugggagaauacuga

SEQ ID NO: 6811 - RNA, 4275 nt, Artificial Sequence
  Cas9 variant
augaaaaggauacuggggcucgaccucggcaccaacuccauaggaugggcccucgucaacgaagccgaaacagacgaggaagugagcuccauaauacgacugggaguccgagugaacccacucaccgucgacgaaacacaaaacuucgaaaagggaaaaagcaucacaacuaacgcggaacgcacucugaaacgaaguaugcgaagaaaccuacaaagauacaagcugcgccgcgacgcccucguugaguuccucaaagaacuaggcuucaucacagacgaaacuauucucuccgaacaagggaaccgaaccacguuugaaaccugucgccuacgcgccaaagccgcggaagaggaaaucagccuggaagaacuaucccggguccugcugaugaucaacaagaaacgcggcuacaaaucguccaggaaaguaaagaaagaagaggacgggguccucaucgacggcauggaaaucgcgaagaaacuauacgaggaggaccuaaccccaggacaacuaugcucccaacugcucgaaagcgggaagaaaguacuuccggacuucuaccacuccgaccuacaagaggaacuagacagaaucuggucuguacagaaacaauuccaccccgacguguucugcgaugcggcgaaggaagaaaucaaaggaaagaaccgcagucagacaugggccauccucgccaacuacuucguuuggaaagaggagguggugggcuggaacgaccgagaggccaaaaacgagaccauagaaaaagagugcaaacuugugggacugaaacgcaccacuaaaggauacgaacuaaagaaagaaaacuaccgauggagagcccaggcacuaaccgaacaacucggccuagaggaaauagcggucguccugcaagagauaaauggccagauaaacgccagcagcggcuaccucggggcgauaucggacagaucaaaagugcuauacuucaaccaccaaacaguuggacaauaucagauggccgaacuugacaaaaacccccacgccucacuccggaacaugguauucuaccgccaagacuaccucgacgaguucgacagaauaugggaaaaacaagcggaguuccacaaagaacucaccgcggaacuaaagaaagaaaucagggacaugauuaucuucuaucagcgacgccuaaaaucgcagaaaggauugaucagcuucugcgaguucgaacgucucgaaauaguagucgaaaaagacggaaagaaacaaacgaaaguaauaggcugcaaagucauaccacgaagccauccacucuuccaagaguucaaagucuggcaaacauuaaacgacauuaaagugcucggccgggagaaaaagcgaaacgcgcuaucggcaagcgaaagccgagcccucuacccggaagaaaaggaaauccuggcccgagaacucgcgaucaaagaaaacaugaaaaaggcagacguacuaaaacuccuauuugaaaacccccaagaauuagaccucaacuucaagcaaauagacggcaaucgaaccggcuucagccuauucucagccuacaguaaaaugauagaaaaauacggauacgagccccuagacuucaagaaacccgcagacgaaaucaucgggcaacucaggaccaucuucaccgaccugggcuggaacacgaaucuuuucaccaucgauuuaacaaaagaaggaaaagagcuggaaaugcaaccguacuuccgacuuuggcaccuccuuuacucauucgaaggagacaacaccuccaccggcaacggcaaacucauagagaaaauaaugcagcuaugcggagucgaaaaggaauacgcaguggaacucgcaagucuuucguuucaagacgauuacggaucacuaagcgcgaaagcgauaaaaaggauccuucccuaucucaaagaagggaaccuauaugacgucgcgugcgaguacgccggcuaccgacacucaaaaagcucacuaacgaaagaggaaaucgaaaacaaaguucugaaagguaagcucgagguccuccccaaaaacagccuacgaaacccgguagucgagaaaauccucagccaaaugguaaacguaauaaacacaaucaucgacacguacggaaaaccagacgaaauucgcguagaacuagcacgcgaguugaagaagagugcaaaggaaagagaggaacucaccaaagcaauagcgaaaaguacccgagaacaugaagaaauaagaaaacuccuacaggacgaguucggcaugaugaauguaagccgcaacgacaucauacguuacaaacuuuaugaggaacuaaaagacaacggcuacaagacccucuauucaaaccaauacaucccaaaagagaaaaucuucagcaaggaaaucgacaucgaacacaucaucccccaaucccgacuguucgacgacagccuaucaaacaaaacacucgaauacaaagcgauaaauaucgaaaagggaaacaagacugcguacgacuucguaaaagaaaaauacggcgaagagggccuacaacaguacaucaacagaugcgaaucacuguucaaugacaaaaaggcaaaacucagaaagcuaaaaauggagcaaaaggacauacccgacggguucauagacagggacuugaggaacacgcaguacaucgccaagaaagcgcucgccaugcugaacgaaauaugccgaagaguagucgcaacaaccgggagcauaacagaccagcuccgcgaggacuggcaacucgucgacguaaugaaggagcuuaaucugcccaaguacgaagcccuuggcuuuguagaaaccuacgaggauaaagacggacgcaagauaaagagaaucaaagacuggaccaagcggaacgaccacagacaccacgcgauggacgcgcugaccgucgccuucacgaaagaugccuucauacaguauuucaacaauaaaaaugcagcucaagacucgggcaaccguaaucacacaaacaucauagggaucaaaacccguuacuucgacaaaggcagagcccucccacccaucccccuagaacaauuccggauugaagcaaaacagcaccuagagaagcuccuagucaguauuaaagccaagaacaagguagugacgguaaacgugaacagaacaaagaaaagaaaaggagaaaacacaaaaauacaacaaacgccccgcggccaacuacaucucgaaacgguauacggcucccacaaacaauacguaacaaagaucgaaaaggucaacgccucauucgaugcagccaagauugccaccgucagcaaacgcgccuacaggaacgcccuccuaaaacggcucgaaaccuucggaaacgaccccaagaaggcguucacuggcaagaacgcacucgagaaaaacccacuauacgccgacaaauaccaaaccauccgagugcccgaaaagguacaaacagucgaauuugaaaccauuuacacaaucaggaagccggucgaccccgcccucaacguagacaaagucgucgauguaaagguccgcgcaauacucgaacgccgucucaaagaauacggaggggaccccaagaaagcguucgugaacuucugggaaaaccccaucuggcugaacaaagaaaagggaauaucaauaaaacguguaucuauacgaggaaucaauaaugcgcaaaguauccaugucaagaaggacaaaaacggcaaccccauaugggacgagaacggaaaacaaaucccgguggacuucgugaacacgggcaacaaccaccacguagcuaucuacagaaagccuguccucgacaagaaagggcaaguaacauuugacgaggacggaaaccucauguacgaacucgacgaagucgugguacccuucuuugaagccgugacgcgggcaaaccuggggcuccccaucauagacaaagacuaccgcaaaucggaaggauggcaauuccuauuuucaaugaaacaaaaugaauauuucgucuuccccaacgagaaaaccggcuucaaccccaaggaaguagaccuucugaacccagacaacuacgcgaugauaucacccaaccuauucaggguacaaacuauguccaaagucauguacgggaacaacgugguaagagacuacaaguucagacaucaccuagaaacuacugucaaagacaugaaagaacuuaaagacauagcguauaagcaguacaagacauuguccuucgguaauuccguuguaaaaauccgaauaaaccacauagggcagauagucucggugggggaguacuga

SEQ ID NO: 6812 - RNA, 4278 nt, Artificial Sequence
  Cas9 variant
augcgccgcaacauacucggacucgaucuuggcacgacgucaauaggguucgccaaggugauagaagacgaagacuaccaaaacagcgcagucgagcugaucgggguccgagucaacccuuuaacaaccgacgaacagacaaauuucgagaaagggcggcccgugucggucaacgcagauaggacacucaaaaggggcaugcguagaaaccuggaccgauaccaacuccgccgccaccacuugauagaagugcucaaggccaaccacauaauaaccgucgacacuaagcucgcagaggacggcaaaaauaccacccacgcgaccuacgccgugagggcccuagccgcaacagcagaaaucccccuagaagcauucgcgcguguauugcucgccauaaacaagaaaagaggcuauaaaagcucccgcaaagccaaaaaugaagaugaaggacaacucauagacggcauggccgucgccaaacgacucuaugaagaaaaccucacccccggccaacucaguuaucuucuccucaaggaaggcaaaaaguaccucccagacuucuaccgauccgaccucaaugcagaacucgacaaaguauggucguuccagaaacaauucuauccagaaauccucaccgaagaauuuaagaagcaccuggaaggaaagggacagcgcgccacaucagccgccuucuggggccaauacggauucaacacugccgaaaacaaaggcucacgcgaggagaagaagcugaaagcguaccaauggcgcuccgaggcgguagaucagcaacucacgaaagaggaggucgccuacguaauaacagaaauaaacaacgaccucaacaaaucgagcggauaccuuggagcaaucagcgaccgaucuaaggaguuguucuuuaacaagcagacaguaggccaauaccucuaccaacaacuaaagcaaaacccccacacccgacucaaagggcaaguguucuacagacaggacuaccucgacgaguucgaaaccaucugggaaacccaagccaaauuccaccccgaacuaacggcggcucugaaagaagaaauccgggacgugaucauauuuuaccagcggaaacucaagucacagaaaggccugaucucauucugcgaguucgaauccaaagaaaucgaaguagagaaaaauggccuaaagaucaagaaaagaaucggccuaaggguagcacccaagucaucgccccuguuccaagaguucaagaucuggcaaguucugaacaaccuugaguuccggaacaaauccucuaaagaagucuucguaccagacaugacagcuaagcaacaacuuuucgacgaacugaacauaaagggaaaccuacucgccuccgaagccauaaaaauccucggguacaaaacaaaagacugggaagcgaacuaccacacacuagaaggcaacagaacaaauaagucgcuauacgaugccuaccugaagauccucgaacuugaagguuacgacgaagaccuacucaaacucaguggcagugacgacauagacgugagcaaaaucgaaaaaucagccagcgaaaucaaacaaaugguccacgcgguguucgaaguucuuggcauaaacucuacaauauuggacuucgacgcugaagcggacgguaaagcauucgaacaacagaccgccuaucgacucuggcaccuacuguacagcgccgaagacgacaacaaaaaguaccuccaagaagauaucuucauauacggacaugacaacaucggguugaaaaagaaacuaugcgaacgcuucggcuuucgccccgagcacaccaaaauccuagugaacguugcauucagcggugacuacggcucucucuccuccaaggcgaugagaaagaucuacccguucauuaaggaacuaacauaugacaaagcgugccgcgaggcgggcuauagacacucggcaagcucgcucuccaaggaagaaauagccacacgaccguugcagaaaaggcuaggacugcuaaagaaaaacgaacuccgcuccccggucgucgagaagauauuaaaccaaaugguaaacgucguaaacgcccucaucgacgaugagaauaaaaggcgaaaggcccgaggacuaucggacgauuuccacuuugacgaaauccgcauagagcuagcacgggaacucaagaaaaacgcaaaagaacgcgccgaaaugacaacuaauaucaacgccgccaaacaacuacaugaaaagaucaucaagauacuacaaacccaguucggcguaagcaacccaucacgcaacgauauaauccgauacaaacucuacgaggagcuuaagaauaacggcuacaaagaucuuuacacaaacacuuacaucucccccgacauccuauucagcaaacagauugacaucgaucauaucaucccucaaaugagccucuucgacgacucauucaguaacaaaacagucgucuuccgcaaagacaaccaagacaaaggaaacaaaacagcguacgacuacauacucggaaaguacggagagcuugcacuggaagaauacauaagccgaaucacgucccuauucgaacugggcaagaaaaauaaagaggaaggcaucaacaaagccaaauuccaaaaacugcagaaaaggcucaucgauaucggggacggcuucaucgaaaaagaccucagagaaagucaauacauagccaagaaagcgaaaaacaugcucuacgccaucugcagaagcguaguggccaccagcggggaaaucaccgcacgccuccgugaagacugggaccuggucaauguaaugcaagaaauuaaccucccgaaauuccgcgcccucgggcucacagaaaugguugagaagaaagacggaggacaaaaagagaggauaauagacuggacuaaacgcaaugaccaccggcaccacgccauggacgcacucacaauagcguucacgcgacacucccacauacaauaccucaaccaccucaaugcacgcaaggacgaagcauccaaauggcacccuguaguaagcaagauagaggagaaagaaacagaucuggucuacgacgaucugggcaaccggaaaaggagguuuaaagcgccuaugccaaacuuucgggaagucgugaaagaacaccuugaaaacguguuaauaagccacaaagccaaaaacaagguaguaaccaaaaacaaaaacaagauaaaaacagcaaaaggagagaaaaucaaaacagaacugacuccgagaggccaacuccacaaagaaaccaucuacggucgguaccgcuauuacgaaucgaaagaggaaaaagucggaccaaaauuugacgccgaaacaaucgggaugguuguaaacccacaauaccggaagcugcugcucgagcgacucacaaccaacggaaacgaccccaagaaagccuucggcggcaaaaacacacugucuaaaaauccgcuauacauugacgaggcaaaacaggaacuacucccagagaaaauccuacuccguuggcuuaacgacgacuacuccauccgcaaagacgucaccccggaaaaucucaaagacgucaaaaccaucgaaaagguacucgacgaaggcaucaagaaaaucuuacuuaaaagauugguagacuucggcaacgaccccaaaaaggcguucuccgaucuagacaaaaacccaauauggcucaacgaagccaaaggaauaacuaucaaacgagucaccaucucaggcgucaaaaacgcggaagcacuccacuacaaaaaggaccacuucggaaacgcaauccucaacgaaaacggcaaacuaauaccaucaucauucgugagcacgggcaacaaccaccacgucgccaucuaccgcgacgccgaggggaaucuucaagaacgaguaguaucccuauucgacgcaguucaacucgucaacgccggcgaagcgguaaucgaccgagaauacaacaaaggcauaggcuggcaguuccucuucacuaugaagcaaaacgagauguucguauucccgaacgagaaaacaggauucgacccaaaggaaaucgaccugcuaaacacagauaaucgaaagcuaaucagccccaaccucuucagaguccaaaagauugccuccaagaacuacuucuuccgacaccaucuagaaacgaacguggaagaacgaaaagaacucaaggacauaguguauaaaccucaacucggccuaaacgcaauaaaggacguugugaagguccggauaaaccaucucggcaaaaucaucuccgucggagaauauuga

SEQ ID NO: 6813 - RNA, 4281 nt, Artificial Sequence
  Cas9 variant
augcccagaaagaacauauugggacucgaccuaggaacaaccagcaucggguucgcuaaaaucaucgaagacgacgacuaccagugcaguuccguggaacuaauaggaguccgaguaaacccgcuaacgacggacgagcagaccaauuucgaaaaagggaaaccugucucggucaacgcagaccgcacccucaaaagaggaaugaggcggaaucucgaccgauaccaacuacggagggacuaccuaauugagauacugagaacacaccacauaaucaccgccgacaccaaacuagcugaagauggcaaaaacacgacccacacaaccuacgcacuccgagcgcuagcggcaacggcggagauccccuuagaagccuucgucaggguacuacucgcaauaaacaaaaagcggggauauaaaucaucccggaaagcuaagaacgaagaugaaggacaacuaauugacgguauggcgaucgcacggcggcuauaugaggaaucacuuaccccagggcaguucuccuaccagcuccucaaggaagggaaaaaguaccuaccggacuucuacagguccgaccugaacacugaacucaacaaggucuggaacuuccagaagcaauucuaccccgaaauacuaacggacgaauuuaaacgccaccucgaggggaaaggacaaagagcaaccgcugucgccuucuggggucaacauggcuucucgauggcggaaaacaagggaucgagagaagagaagaaguugcacgccuacaaauggcggagcgaggcugcccacaagcagcugaccaaagaagagguagccuucgugaucacagagaucaacaacgaccugaacaaaagcuccggcuaccucggcgccauaagugacaggagcaaagaacucuucuuuaacaaacagacgguaggucaguaccuccaccaacaacuaaaagaaaauccacauacccgccuaaaaggacaaguauucuaucgccaggacuaccuagacgaguucgaaacaaucugggagaugcaagcuaaguucuacuccgcacugacacuggagcugaaagaagaaguaagggacgucguaaucuucuaccaaaggaaacucaaaucgcagaugggccucaucucgcucugcgaguucgaaagcaaggaaauagagaucgaaaagaauggagaaaaagccaaaaagcggauaggccuccgagucgccccaaagagcucaccccuuuuccaagaauuuaaaauuuggcagguccuaaauaaccuugaauuucgcaacaaaaagaccaaagaggucuucgugcccgaaauggcagccaaacaacagcuguucgacgaacucaauaucaaggggaaccuacuagcauccgaggccauaaaaauacucggauacaaaacaaaagacugggaggcuaauuaccacacgcuggaaggaaaccguacaaacaaaucucucuacgacgcauggcuuaaaauccuugaacuggaaggcuacgacgaaaaccugcuaaaacuauccggcucggacgacaucgacgucuccaaaaucgaaaagccagcgcucgaaauccgacaaaugguacucgccgucuucgagguccucgguauaagcggagcaauacucgacuucgacgcggaagccgaugggaaggccuucgaacaacaaccggcguaccaacuauggcaccuccuauacagugcggaggacgacggcaagaaauacagccaagaagacaucuucaccuacggucacgacaauaucgggcuuaaaaagaaacugugcgaaaaauucggcuuccggcccgagcauacaaaaauacucguaaacguaguauucucagacgacuacggaaaccucagcaguaaggcgaugaggaggaucuacccguucauaaaagaacucaccuaugacaaagcaugcgcagaagccggauaccgccacucggcagcaucccucacgaaggaagaaaucgccgcccggccccuccaaaaccgccuugaccugcucaagaaaaacgaacuacgcagucccgucguagagaaaauacuaaaccaaauggucaacguggucaacacgcuaguagacgacgaaaaccaaaaccgcaaagcucgcggacucagugaggacuuccacuuugacgagauaagaaucgaauuagcccgggaacucaagaaaaacgcaaaagagcgugcugaaaugacaacaaauaucaauacggccaaacaaucacacgaaaagaucauccggauacuccagacagaguucggcguaccaaauccaagccgaaacgacaucguacgcuauaaacuauacgaggaacucaaaaacaacggauacaaggaccuguacacaaacacguacauaucccgagacauacuauuuagcaagcagauagacgucgaccacauaauaccacaaaugagccuguuugacgacagcuuuagcaacaaaacgguaguauuccgcaaagacaaccaagacaaaggaaacaaaacagccuaugacuacauacuggggaaguacggcgaacaagcucuggaagaguacaucucaaggaucacaucccucuucgaacucggcaagaagaacaaagaagaagggauaggcaaagcgaaauuccagaaacugcaaaaacgccuaguugacauaggugacggcuucauagagagagaccuacgcgagucgcaguauauagccaaaaaggcaaacaacaugcuauaugcgaucugccgcagcgucgucagcacaucuggggaaauaaccgcacgacucagagaagacugggacuuggucaacgucaugcaagaaaucaaccugcccaaguuccgcgcccugggacugacagaaauggucgagaagaaagacggagcccagaaagaaaggaucaccgacuggacgaagcgcaaugaccacagacaccacgccauggacgcccuagccaucgccuucacaaggcacucccauauacaguaccucaaccaccugaacgccagaaaagacgaagccaacaaauggcaccccguaguauccaagauagaagaaaaagaaaccguacuaauauaugacgaccuuggaaacagaaaacgcaaauucaaggccccaaugccaaauuuccgcgagguaguaaaagagcaccucgaaaacguucuaauaagccacaaagcgaagaacaagguagugaccaagaacaaaaacaaaauaaaaacagugcgcggugaaaagguaaaaaccgaacucaccccaaggggccagcuucacaaagagaccauauauggccguuaccgcuacuacgaguccaaagaagagaaaaucggccccaaguucgacgcagaaaugaucgggauggucacaaacccacaauacaagaaacugcuccucgaaagacucgcagcaaacggaaacgaucccaagaaagcauucugggggaaaaacgcccuaaacaaaaacccccucuacguagaugaggcccgccaggaacuccuacccgagaaaauccuacugagguggcucaacgacgacuauaguauacggaaagacgugacacccgaaaaccuaaaagauauuaaaacgaucgagaaaauccuagacaaaggugucaagaaaauccuacuaaaaaggcuagccgacuucggaaacgauccuaaaaaggcuuucagcgaccuugacaagaacccaauauggcaaaacgaagccaagcgaauagccaucaagcgggucacgaucucaggaauuaaaaacgcggccccacugcaccacaagaaggaccaccucggcaacgauauccucgacgagaaagggaaacagauucccuccucuuucguaagcacgggaaacaaccaccauguggcaaucuaccgagacgccgaaggcaaccuacaggagcgaguggucucgcuuuucgacgcgguacaauuagugaacggcggggaaccggucaucgacaaagaauacaacaagggaaucggauggcaguuccuauuuacgaugaagcagaaugaaauguucgucuucccggaugagaaaaccggguuuaacccgcgggaagucgaccuccuaagcagugguaaccgaaaacucaucagccccaaucuauuucgcguacaaaaacucgccucaaagaacuacuucuucagacaccaccuagaaacaagcguagaagagaagaaagaacugaaaaacauagccuauaagccacagcuuggccucaacgcccuaaguaacauagucaaaguacgcauaaaccacaucggugaaauagucuccguaggggaauacuga

SEQ ID NO: 6814 - RNA, 4281 nt, Artificial Sequence
  Cas9 variant
augaaaaacauccucggccucgaucucggcauuacaucgaucagcuucgcgcauaucguagaagacgagaacaaagaaaagucggaaaucaaagaacuaggcguacguauaguuagccugacgacugacgaacaaucagacuuugagaagggcaaaucgaucacaacuaacgccaacagaacccugaagcacggcgcccgucugaaccuugaccgcuaccagcaacgacgcaaguaccucaucgaccuccuccaaaaggcaaaccucaucacaucaucaucaauacucgccgagaacggcaaaaacacaacccacagcacauggcaacugagagccaaggccgucaccgaacgcaucgagaaagaggaauuugcacgaguccuacucgccauaaacaagaaaaggggcuacaaauccagccguaaagcgaaaaccgaagacgagggacaagccauagacggcauggcgauagcaaaacgacuguacgacgaaaaccuaacuccaggccagcugucgcuccaacuucuccagcagaacaagaaacuccuacccgauuucuaccgaucagaccuccaacgcgaauuugaccucguauggaacuuccaaaaacaguucuacccugacauacuuaccgacaguuucuacaaagaauuacagggcaaaggaaaagacgcaacauccaaagcauucucgaagcgguaucauuuugacaccgcagagaacaaaggcucuaaagaauccguacgccuacaagccuaccaguggagggcggaggcaaucuccaaacagcuaucuaaagaagaaguugccuauguccucacagagauuaacaacaauuuaaacaaugcaagcggguaccucggggcgauaucagacagaagcaaggaguuauacuucaaccgacaaaccguaggccaguaccucuacgcgcagcugcaagaaaaccgacacaacucacucaaaaacaaggucuuuuaucggcaggacuaccuggacgaauuugaacgaaucugggaaacacaagcgagcuuucacaaggaacucaccgacgaacugaagaaacaaaucagggacgugguaaucuucuaucaacgcaaacugaagucacagaaaggacuaaucuccuuuugcgaauuugagagcaaagaaauagaaaucgaaaaagacggcaaaacaauaaccaagaccaucggugcgcgugucgucccaaaauccaguccccuuuuucaggaguucaaaaucuggcagauacuaaacaacguuaccugcaaacgcaaagggauacgaaagaagaaauccagugccaaaucgacagaacucgaucuuuuuaaugagccaucccagacuaucuucucacucgauauggagugcaaacagcuccucuucgacgaacucaacuugaaaggcgacuuaaaaagugacaagguacuaaagcugcucggauauagcccccaagaaugggaaauaaacuauaaccaacuagaagggaaccgcacacaaaaggcacucuacgaggccuaccucaagauagucgaaauggaggcgcacgacgugaaggacauccuccaaauuaaauccgcgaaagacgacuggucgcucgacgaaagcccgcuguccgcaagcgagauaaaggaaaaagucaaggauaucuuccaagcacugggaauaugcaccaaaauccuguacuucgacccccuacuacccgucaaggaguucgaaaagcaagacucguaccaacucuggcaucuccuguauagcuacgaaucagacgacuccacaucgggcaacgaaacgcuauaccgcauacuugagaagaaauacgccuucaagagggagcacgcaagaauccucgcuaacgucgcucuacaagacgauuacggaagccucuccaccaaagcgauccgcaaaaucuacccgaacaucaaagagaaccaguacuccaaggcgugcgaacuagcaggguauaaacacucuaagcucucccuaacaaccgaagaacuggaagccagagaacucaagaacauaauaccccuucuaaagaaaaacgcccuacggaaccccguaguagagaaaauacugaaucagaugauuaacgucguuaacgcucuuauagagaaaaacucggaaagagacgcagagggcaaaaucaccaaguacuuccacuucgacgagauacgcaucgaacucgcccgcgaacuaaagaaaaacgcacaaaagcgauacgaaaugacacaaaacauaaacaaggccaaacucgagcaccagaagauaagcgaaauccugcaaaagaaauucggcaucaaaaacccaaccaaauccgacaucauucgguacaggcuuuaccaagaacuggaacacaacggauauaaggaacuguacaccaacgcccccauagcccgcgacaugcuguucuccaaaaauaucgagauagaacacauugucccaaaagcacgcgucuucgacgauucauucagcaacaaaacccucacuuuccacagaaucaacuccaacaaaggggaguacacagcguucgauuacauaacaucccuaaacucggaagaggaacucaaccaauaucuuacacgcgucgagaacgccuacaagacaaaaagcaucuccuuaaccaaguacaaaaaccuucucaaaaaggcaucagagauuggcgacggcuucaucaaccgggaucuaagagauacgcaauauaucgcaaagaaagcaaaagaaauccuauuccaagucacgaaaaacguccucucaacauccgggucgauaacagaccgacugcgagaggacuggggucuaguagacgucaugaaagagcugaacaugccgaaauaucagagccucgggcugaccgaaguggaagaacgcaaagaagguaacaaaguaacaguaaucaaaaacuggaccaaaagaaaugaccaucgccaccacgcaauggacgcccuaaccguugccuucacgaaaccaagcuacauccaauaccugaaucaccuaaacgcgcgcaaagacgaaaauaacaaaaauuacucagucauccuagcuaucgaagaaaaagagacaaucaaggucccaaccaauaacggcaagaacaaacggguauucauagaaccaaucccaaauuuccgucaggucgcaaagaaacaccucgaagaaaucuucauaagccacaaagccaagaacaaagucgucaccaaaaacguaaauaagcccgcaggaacagacaagcagcaaaucacccugaccccgcgcggccaauugcacaaagagacaaucuacgguaaauaccaguacuacguaaacaaagaggagaaagucggggucaaauucgaugaaaggacaauaaccaaggucuccaacccccuauaccgcgaagcacuucuaaagagacuacaagcgaaugacaaugacccgaagaaggcguucacuggcaagaacgcacucucuaaaaacccgauauaccucgacgaaaccaagaccaaaacccuacccgagaaagugaaccucacauaccuagaagaagauuucucgauccgaaaagauaucaguccggacaacuucaaggaccucaaauccaucgaaaaggucaucgaccaggggguaaagagaauccuaaucaaaaggcuacaagauuacgacaacgacccuaaaaaggcguucgucgaccucgagaaaaaccccaucuggcuaaacaaagagaagggaaucgcaauaaagcgggucacgaucagcggcguaagcaacgcccaaccucuccacaucgggaaagaccaccucggaaaaaccacccugaacaaagaaggcaacgagauucccguagauuacgucuccacagguaacaaccaccauguagcgauauacagagacaaagagggaaaccugcaggagcaaauugucuccuuuuucgaagcagucguacgcacccagcaaggacuccccaucaucgacaaaaccuauaagcaagaagaaggcuggcaauuccuuuucacaaugaaacaaaacgaaauguucgucuucccaaacgccacaacagguuucaacccggccgagauagacuugcuagaccccaaaaauaagaaacugaucagccccaaccucuuccgcgugcagaaaauagcgaccaaagacuacuuuuuccgccaccaccucgaaacaaacgucgaaacagacaacguacucaaaaacacgaccuggaaacgagagggucuuucaggccuaaaagacaucgugaaaguccguaucaaccaccucggagacauuguaucaaucggagaauacuga

SEQ ID NO: 6815 - RNA, 4281 nt, Artificial Sequence
  Cas9 variant
augaagcacauccugggucuggaucucgggacgaacagcaucgggugggcacuaaucaagcaggacuucgaaaacaaacaaggagaaauacuuggaaugggcucaagaauaaucccaaugagucaggacauacugggagacuucggaaaagggaacagcguaucccaaacggccgagagaaccaaguacagaaguguaaggaggcuccgagaacguuuccuacuucgccgagaaaggcuucaccggauacucaacguccuuggcuuccuccccgaacacuacgcgucacagauagacuucacgaaaagauucggaaaguucaaggaagaaaccgaaccgaagcucguguacagcaacgaaggauucauauucaaaaagagcuucgaagaaaugcuguccgauuucaaaacacaccaaccacagcuccuagaggacaacaagaaaauccccuacgauuggaccaucuauuaucugcgcaagaaagcacucagccguaaaaucgaaaaagaagaacucgcguggauccuacucaacuuuaaccaaaaacguggcuacuaccaacuacgaggggaagaggaggaagaaaaccccaauaaacuaauagaauuuuacagccucaagauaguggacguacuggccgacgaaccucaaaaaggaaagucagacaucugguacucauuaauccuagaaaacggauggauauaucggcgaagcucaaagacuccacuuuucgacuggaaagagaaaacgcgcgacuucaucgucacgauagaccucaacgacgauggcagcguaaagacggacaaggaaggcaacgaaaagcgcagcuucagagcccccggcgaaaacgauuggacccuggucaagaaaaagacagagcaggagaucgacagcagccggaagacagucggaacguacaucuacgaaacccugcucaaaaacccuaagcagaaaauaaaaggaaagcuaguucgcacaauugagcgaaaauucuacaaaacagagcuuaagcaaauacuggaaaaacagaaggaauuucaccccgagcucagacaggaugaccuuuacagcgacugcguacgcgaauuauauaagaacaacgaagcacaccaacucacucucagcaaaaaggacuucgugcaccucuucauggaagacaucauauucuaccaaaggccacuuggcagccaaaagagcucaauaucuaauuguacccuagaguuccgcaaauacaaagacgagaacggaacagagcacacacaauaccuuaaggccauucccaaguccaacccauauuaccaggaguuccgcaucuggcaauggauguauaaccuaaacauauacaagaaagaagacgacacaaacgucacgaaagacuuccuaaacaccaaagccgacuuugaaagccucuucgaguuccucaacaaccgcaaagaagucgaccaaaaagcccuucugaaacacuucaaacuaaacgauaaaacccaccgcuggaacuacguugaagacaaaaaguacccaugcaacgaaacaaagaccaugauccugagccgacuggacaaaguagaaaacauaucggacgacuuccuaacacgcgagauggaacagaagaucuggcacauaaucuauuccgucaaugacaaaguggaauacgagaaagcccucaagagcuucgcaggaaagaauaaccuggaggacaacuccuucuucgaagccuuuaagaaauucccacccuucaaguccgaauacggagcauucucagaaaaagcaaucaagaaacuccuaccauuaaugcggauggggaaauucuggaacuacaacaacauaagcgaacaaagcaagagccgaauacagaagauuauaaccggcgaauacgacgagaacauaaaggacaagguccgcgaaaaagcaauccaccucacaaccgaaacugacuuccagggccugcaacuauggcugguccaauauauugucuacgggaggcacuccgaagccgcaauguuaggcaaauggaacagugcagacgaccuggaagaguuucucaaggaguucaaacagcacagccugcguaacccaauaguagaacaaguaaucaccgaaacacugcggguagucaaagacaucuggcagaaauacggaaacggugcuaaagacuucuucagagaaauccacaucgaacugggucgggagaugaagcugccggccgaggaaagagagcgacugacgcggcagauaucagaaaaugaaaacaccaacuuucgaauaaaagcccugcucgccgaaaugauggacgacaacagugucgaaaacguccgacccuucucccccaugcagcaagaaauacuaaagaucuacgaggagggcguacuaaacagcgauauagaaauagaagacgacauccucaaaauaagcaagaccgcccagcccagcaguagcgaccuuaagagauacaaacucuggcuggagcagaaguacaagucacccuacacgggucaaaucauccccuuaaacaaacucuucacuccagaguacgagauagaacauauaaucccccaaucccgauacuucgacgacucauucacgaacaaaaucaucugcgaaagugcgguaaacaagcuaaaagacaacuacaucggccuagaauuuaucaagaaacucgguggaucaaucgucgaaugcggcaacgggaaauccgucgccauacuuaagcacgaugccuacgaagacuucaucaagaaacacuacgcaaacaaccgaagcaaacguaacaaacuccuccucgaagacauccccgagaaaaugauagaaagacaaaugaaugacacccgcuacaucagcaaauacaucagcggcgugcuaucuaacaucguaagaguagaagauggcacagacgaaggugugaacagcaaaaacauaguccccggcaacgguaaaaucacgacacagcucaaacaagacuggggccuuaacgacguauggaacgaccuuauacuaccgcguuucgaacgcaugaaccaccugaccaacucgacagacuucacggcuuggaacgaaaaucaucagaaguuucugcccaccguaccagucgaguucucuaaaggauucucaaagaaacggauagaucaccgacaccacgcgcucgaugccuuggucaucgccugugcgacgaaagaucacguuaaccuccuaaacaaccaaucggcgaaaagcgacaccaaacgcuacgaccuuaagaagaaacuuaugaaauuugaaaaagucgccuacaaccacccccaaaccggagaacggauagagcgggaagcaccaaagcaauuccucaagccaugggaaaccuucacaauagaugcuaaaaaccaucucgagacaaucauagucagcuucaaacagaaccuccgaguaaucaacaaagccaccaauuacuaugagaaauacguagaaaaggaaggaaccaaaguaaaggagagagucgaacaaaaaggcaccaauugggccauaagaaaaccaaugcauaaagaaaccguaagcggaaagauagaccucccccgcauaaagguacccaagggaaaaauccuaaccgccacccgcaaaucccuggacaccagcuuuaaccucaaaacaaucggcaguaucacggacacaggcauccaaaagauucugaaaaacuacuugcaauacaaagacaacaacccggagcucgcguucagcccggagggaauagaagacaugaacaaaaauaucgagaaauucaacaacggaaaggcucaccaaucaaucuccaaaguccgcgucuucgaacucggaaguaaauucccccucggacaaucagguaacaagaaagaaaaauacgucgaagcugccaaaggaaccaaucucuucuucgccauauaccaggacaaaaauggcaaaagaagcuacgaaacaauccccuuaaacgaaguaauugaacgccaaaaacagggccuaagcgugguagaccucaaaggaguagacgacuucuaccuuucccccaacgaccuggucuacgucccgagcgaggaugagcuagaaaacaucagcaugaucgacuucaacaagaugucaagugagcgcauauacaaggucgucagcuucaccgggaaccagauauucuucguacgccaagacauagcgacaucagugguaaacaaagccgaauuuuccacuuugaacaagauggaacgcgcaauagacggcacaaugaucaaagaaacgugugucaagcuacaaaucgacagacugggcaacauuucaaaaaucuga

SEQ ID NO: 6816 - RNA, 4281 nt, Artificial Sequence
  Cas9 variant
auguacaacaucggacucgacaucggaacgggaagcgucggcuggugccuaacggaugaaaacggauaccuucucaaggucaacaggaaaggaaacaaugggaacaccuaucgaaacagcgccuggggcguacgucucuucgaauccgccgacaccgcggcagacugccgaauaaaaagguccaccagacgacgguauaaacggcgccggaccagaauaauagaguuacgcaaaaucaugagcgacaugaucaugccaaucgaccccaacuucuacgcccgacucgacgaagcauuuuuauggaacgaggacaaauccgacaaagccaaggccccguuccuccuguucaacgacaacggcuacgacgacguaaaauacuauacagacuaccccacaauuuaccacuuacgaaaacaccuucuagaaaccaaggaaaaagccgauccgcguuucauauaccuagcccugcaucacaugaugaaguacagaggccacuuucucuucgagggacagagcuuugaggcgaucgacaacaucgaggacacauucauagaacuugagcaccuagucaacguauaugucaaggagaaagaggacacagauaacaacgccgaaaacaacgcgcuguaucaagagaugaagaauuaccuagccgacaacaaagucaaaaacaaagacaaaaaggaguacaucacggacacguucaucaaggcagacuaugacaacaaguacucaaaggaacuggcagcagcgguacucggcuacgaguucaaugugggaaucaucgucaacgacaauucacucaccgacgaagacggaaaagcccugaaagcaaaguuugccgaugcaaaauacgaagagaaggaggaaaaacuaagcgacacacuaggcgaacgcuacuacauaaucgaaacccugaagaaaaucuauuccuggaaaguacuacacagcauauuaggcgacaacaaguaucuguccuacgcgaugguggacaaguacgagaagcacagugagcaacuaaaagcacuaaaauaccuauuccauaaguacaccagccaagacgaauacuccgaguucuuccaccaagaaaagaacaaagaaggaaaauacauaguaaacuacgcgaacuauauuaaaggcaucaagcgacugagcaacgaaacuaacaagaaauacaacacuaagcagcaguuauaccagucgauuaugaagauccucggcgagcgcgcggccgaugaugaaguauauaagaaaauccuggucgaaauggaacaagaaacauuccuggagaaaaucaacaacgucgacaacagcgcuaucccauaccagcuaaaccucauggaaauggacaagauccuaacccagcaaggaguguacuacaaagagcuaagagacaauaaggaacuacuccuaaaaaugcucacaucgaagauacccuauuaugugggaccgcuuaacaacaacagcaacggaaacagaaacuucgcguggaugacaaagaaagacggcaaagagaacgaaaaagucuacccguggaacguuaaagacguagucgacauagacgugaccgccgaagacuucaucacaagaaugacuaacuacugcacauaucucccaaacgaaaaaguacugccaaaagaaagccuacucuaccaacgcuacauguuacucgaagaauuaucacaaauaagaauagacggaagaaaacuuagcaaggaggaccgaaaagccaucauaaaugaccuguucauaggaaaaggcagagugaaagucagcgacaaagacuucaaggaguaucuuaacaaaguaaacuacgucaaagucaacggcaagggcuacgacgugaccggcuaccaaagcgacgacgguuucgccugugcgcucagcagcuacaacaaguuccgacgcauacuaggucauauagacgaacagaacgaaaagaugauugaggacauaaucuacuggauaacaguauucgaagacaaggacauagucaagcgaaagauaaacaagcaauacgcggacagacuuagcgcagaacagcuaaagaaaauauuaaaauugaaauucaagggcuggggccguuauuccucaaaauugcucaacgggauaaaaggcgacaugggcacaacgauaauagaaaugcucgaagaugccgacgagcgauucgcuuacugcgacuauugccccaacuuuaugcaaauaauaaacaaagacgagaaaauuaagcaaaucaucgacgacaaccgcccccgguacgacggcacaaaagaccugcucgacguaauccaggacaugcauaccagccccgccaaccgccggggcauauggcaaacgaugaaagcgauagaggagauaauugaguacaugggggagaaaccacagcagauuuacaucgaguucgcccgcgaagaugacccgaaggccaagaacaaacgagcagacuccagaaaacgggccaucgacaaagcguugaagaaacucaaagaggacguagucgacgaguacaacgagaaaguguacaaagagcucaaacaauaugagaagcggcucgacgaggaaaaagucuaccuguacuucaugcaaaacggcaaggaccuguacuuccccgauaaagaacuaaaccuugacgagcucgaaaaacuugagaucgaccacaucauaccguacucccucagcgacgacgacucacuagacaacaaagcacucgugcuuaaagguaacaaccaaaauaaaggcaacaaaauagucaaagaagccuucccacaguuguucagcaauucgggcacagucaacuacuggaagaaccugaagaaagcgggcuugaucagcgaaaagaaauacaacaacuugcagaaaaacaauguugacgacauacuaacaaaggguuucauuaaccgccagcuagucgagacccgacagaucgugaagucaguggccaaccucauccuagacuacuacaacgagcagaucgacguaaucgaggugaaagccagccucucgacuucaguccgaaaaaugcucaccuacgagaaaaaggacaacaacggguucuggauagaaaacaaggacaauugcauguucuauaagaaccgagacaugaacgacuaccaccacgcgcacgacgcguaccuagccaacaucauuggccuauacauacagaaaaacuacccgcgacugcaaaaagaacucaacuacucgcaauaucgccgcauauggagaaaauacuacgaaaacacgaaaaacaacaacggcguaaacugguucgcaacccucggcaaguucaguucaaacaacgaagaagcagauugguacggacaagacaucaucgcuuauaugcggaagaucuucugcuacagagacguacugaucucgaagaaaguggaagaaaacaccggcgccuucuacagcgaaaccaaauauccacgcgaagacaaggcaggcaguaagcucgucccccucaaacaaggcaauaacaugcgaggcgccaacaaccuuaaagagcucgacgccagaaaauacgggggcuacaaaggaggagaaaaagccuacuucguccucguaaaauacugcaucgagaaggcgcuaaagaagaaagugaaaaaggaauaccauauggaguucguggaaaucccugucuacaucgccagaggcaucaaaaacaaagacauuaaccuauacgacuacgugugcgacauccucaaugaagcaaacaagaacucaguagcggacguagaaauccugcgcaauaaagucccaaaauaccaaaugauaauuggcgaaaacggggaagaguacuaccuagucagcgccacagaaguaauaaauucaaagcaauucguccuaggcggggccaaccaacaauauaacagacuuuugaacuacaucaaguacggcaaaaacgauaaguggcaauacauacaaaccgaacuccuggacgagcaacucauugggcuguacaaucuacugaucgccaaaaucaaagacgaguacaagggcuucagcaaagaagccguacgaauacaagaaaacaauagcuucgacaaacuugacgugaaagacaaaaaggaguucaucgcagaaaugauaaagcuaguccagccagacagugacuaccccuaccucggaaaauacgccaccgggcucuccaacaggaugggcaggaagacgggagaaaaagugggaaagaaaauaacccugguugacaagucagucacgggauuguacgagcgacggacaaccuucgaacucgaggacgacuccagcaccaagagcugcuga

SEQ ID NO: 6817 - RNA, 4281 nt, Artificial Sequence
  Cas9 variant
augaaaaacauccuggggcuagaccugggcaccaccagcaucggcuucgcgcacauagucgaggacgaaaacaaagaaaagagcgaaauuaaagagcucgggguacguauaguaagccuaaccaccgaugagcaaagcgacuucgaaaaaggaaaauccaucaccacgaacgccaaccgaacccuaaagcacggagcgcggcucaacuuggaccgauaccaacaacggcgcaaguaccuuaucgaucuacuccagaaagcaaaccuaaucacaccgaguuccauccucgcagagaacgggaaaaacaccacgcacagcacguggcaauuacgcgcaaaggcaguaaccgaacgaaucgagaaagaagaauucgcgcggauacugcuagccauaaacaaaaagcgcggauacaaaaguagcagaaaggccaagaccgaagacgaagggcaagcaaucgauggaauggcaaucgcaaagagauuauacgacgaaaaccugacccccggucagcuuuccuuacaacugcuacaacaaaauaagaaacuccuccccgacuucuaccggucggaccuccagaaggaguucgaucuugucuggaauuuucaaaagcaauuuuacccagacauccucaccgacaucuucuacaaagagcuccaaggcaaaggcaaagacgcaacaagcaaagcguucuccaaacgauaccauuucgacaccacagagaacaaaggcucaaaagaauccguacggcuacaagcauaucaguggcgggccgaagccauaucuaaacaacuuucaaaagaagaggucgccuacguacugacagaaauaaacaauaaccugaacaacgcaucugguuaccucggagccauaagcgaccgauccaaagaacucuauuucaaccggcaaacggucggccaauaccucuacgcaaaacugcaagaaaaccgacacaauucccugaaaaacaagguauucuauaggcaggacuaccucgacgaauuugagaggauaugggaaacgcaagccucguuccacaaagaacuaaccgacgaacugaagaaacaaaucagggacguagucaucuucuaccaacgcaagccgaagucccaaaagggacuuaucagcuuuugcgaauucgagucaaaggaaauagagaucgagaaagacggcaagacaaucacgaagaauaucggcgcacgagucgucccaaaaucguccccccuguuccaagaauucaaaaucuggcagauccuaaacaacgugaucugcaaaagaaaaggaauucgcaaaaagaagaucagcgcgaaaacaacgcaacuggaccuacugaacgaguccagccaaacaauauucagccucgacauggaaugcaagcaacuacucuucgacgagcucaaccucaaaggcgaccuuaaaucggacaagguccucaaacuacuuggguacaguccccaggagugggaaaucaacuacaaccaacucgaaggcaaccgcacacaaaaggcacucuacgaagcauaccucaagaucgucgagauggaggcacaugacgucaaggacauacuccaaaucaaaucggcaaaggacgacuggagucuagacgaaucaccacuaagcgcaagcgaaauccgagaaaaagucaaagcaaucuuccaaacccugggaaucugcaccaagauccuauacuucgacccccuacuacccgugaaagaauucgaggagcaagacagcuaccaacuauggcaccuccucuauagcuacgaguccgacgacagcaccucaggcaacgaaacacucuaucgcauccuggagaagaaauacgcguucaagagagaacacgcacgcauucucgccaacguagcacuacaagacgacuauggcagccuguccacaaaggcaauacgcaaaauauacccgaacauaaaagaaaaccaauacuccaccgcaugcgaaaaagccggcuacaagcacuccaagcucucacucaccacugaggagcucgaagcccgcgaacugaaaaacauaauaccgcugcucaagaagaacgcucuuagaaaccccgucgucgaaaagauccucaaucaaaugaucaacgucgugaacgcucucaucgaaaaaaacucugaacgagaugcggaaggcaagauaaccaaguacuuccauuucgacgaaauccggaucgaacuggcaagagagcuaaagaaaaacgcccaaaaacgcuacgaaaugacccaaaauaucaacaaagcaaaacuagagcaucagaaaauaagcgaaaucuugcagaaagaauucggcaucaagaacccaaccaaauccgacaucauaagguaccgucuauaccaggagcuggagcauaacgguuacaaagaacucuacacgaaugcccccaucgccagggacaugcucuucuccaaaaauauagaaauagaacacaucguccccaaagcccggguguucgacgauaguuucagcaacaaaacucucaccuuccaccggaucaauucagacaaaggcgaauacacagcuuucgauuacauaaccucgcuaaacucagaggaagaacugaaccaauaccucacccgagucgagaacgcguacaagacaaaaucuaucuccccaaccaaguacaaaaaccugcucaagaaggccucggagaucggagaugacuucaucaaucgugaccugcgugacacucaauacaucgccaagaaagccaaggagauacuauuccaggucaccaaaaacguacugagcacaaguggcucaaucaccgacagacuacgugaagacugggggcuagucgacgugaugaaagaacuaaacaugccaaaauaccagucacuaggccucacagagguggaagagcgcaaggacggaaacaaagucaccguuaucaagaacuggacaaagcggaacgaucaccggcaccacgccauggaugcccuaacuguggccuucacgaaaccguccuacauccaguauuuaaaucaccuaaacgcccgcaaagacgaaaacaacaagaauuacagcguaauccuggcgaucgaggagaaagaaacuaucaaaguccccaccaacaacggaaagaacaaaagagucuuuaucgaaccgaucccaaauuuucgccaagucgccaaaaagcaccuugaagaaaucuucauaucacacaaagcgaaaaacaaagucguaaccaagaacaccaauaaaccggccggcacugacaagcaacagaucacgcuaaccccccgcggccagcuccacaaggaaacaaucuacggcaaguaucaauacuauaucaacaaagaggaaaaaauagguguaaaauucgacgagcgaacaaucgccaaagucagcaaccccguauaucgagaagcacuucuuaagaggcuccaagccaacgacaaugaccccaaaaaggccuucgccggaaaaaacgcgcucucgaagaaccccauauaccucgacgagaguaaaaccaaaacccuaccggaaaaagugaaucuaacguauuuagaagaagacuucuccauccgcaaagacaucaguccagacaacuucaaagaucuaaagagcauugaaaagguaaucgaccagggcgucaagcgaauucugauuaaaagacuucaagccuacgauaacgacccgaagaaagccuucgucgaccucgaaaaaaaccccauauggcucaacaaagaaaagggaaucgcgauuaaacgagucaccauauccgguguuaacaacgcgcaaccgcugcauaucggcaaagaccaccucggaaaaacaacccugaacaaagaggggaaagagauacccguggacuaugucucgaccggaaauaaccaccacguggccaucuaccgcgacaaagaagggaaccugcaagaacagaucgugagcuucuucgacgcaguaguacgcgcccaacagggcauacccauaauugacaagacauacaaacaagccgaggguuggcaauuucucuucacgaugaagcaaaaugaaauguucgucuucccuaacgcaaccaccggcuucaacccagccgaaaucgaccuacuggauccaaagaacaaaaaacuaauauccccgaacuuauuccguguacaaaaaaucgccaccaaagacuacuuuuuccgacaccaccuggaaacgaacguugaaacagauaauauauuaaaaaacgugaccuggaaacgugaaggccuauccggccuaaaagacauaguaaaaguacgcauaaaccaccugggcgacauagucaguauaggcgaauauuga

SEQ ID NO: 6818 - RNA, 4281 nt, Artificial Sequence
  Cas9 variant
augaaaaacauucucggcuuagaccucggaaccacaagcaucggcuuuacacacaucguagaagacgagaacaaggaaaagucggaaaucaaggaacugggagugagaaucguaucccucaccacugaugaacaauccgacuucgagaaagggaaauccaucucaacgaacgccaaccgcacacucaaacacggggcccgccucaaucuugaccgguaucaacagcgacgcaaguuccucaucgaccuccuccagaaagcuaaccuuauaacaagcuccucgauacuggcggaaaacggcaaaaacacgacccacuccacauggcaacuccgugcuaaggcaguuacggagcgaauagagaaggaagaguucgccagagugcuacucgccauaaacaagaaacgaggauacaaaucaagcagaaaagcgaaaaccgaggacgaaggacaggccaucgacggaauggcgauagccaaacgccuauacgacgagaaccucacacccggacagcucagucugcagcugcuccaacagaacaaaaagcuacugcccgauuucuaccgcuccgaucuccagaaggaauuugacuuaguguggaacuuccaaaaacaauucuaccccgacauacucacagacucguucuacaaagaguugcaaggcaaagguaaagacgcgaccucaaaggccuucagcaagcgcuaccacuucgauaccgccgagaacaaaggaagcagggaaagcguacgccuacaagcguaccaguggcgcgcugaagcaauaucaaaacaacucucaaaggaggagguagccuacguccucacagaaaucaacaacaaccuaaacaacgcuuccggcuaucugggagcuaucagcgaccgcucaaaagaacucuacuucaaccgucaaaccguuggccaguaccuauacgcccagcuacaagaaaauaaacacaacagucugaagaacaaagucuuuuaccggcaagacuaucucgacgaguucgaaaggaucugggaaacacaagcaucauuccauaaagaacugacggaggaacucaagaaacaaaucagggacgucgucaucuucuaccaacgcaaauuaaaaagccaaaagggccuuauaucauucugcgaguucgaauccaaagaaaucgaaaucgaaaaagacggcaagaccaucaccaagagcauaggcgcaaggguagucccaaaaaguuccccucuauuccaggaguucaagaucuggcagauacucaacaacgugacuugcaagcgcaaaggaauccggaaaaagaaauccagcgccaaaucaaccgaacucgaccucuucaacgaaccaagccaaacaauauucagccuggacauggaaugcaagcaacuucuguucgaagaacucaauuuaaaaggugaucucaaaagugacaaggugcuaaaacuccucggcuacuccccgcaggaaugggaaauaaacuacaaccagcucgaagguaaccggacccaaaaagcccuguacgaggcguaccucaaaaucguagaaauggaagcccacgacguuaaagacauccuacaaaucaaauccaccaaggaugacugggcccuggaagagagcccgcucuccgccagcgaaauacgagaacgggucaaagcuauuuuccagaccuuggggaucuguacaaaaauacuguacuucgacccccuguuacccgucaaagaguucgaggaacaagacagcuaccaauuauggcaccuccucuauagcuacgaauccgacgacagcacguccggcaacgaaacccucuaccgcauacucgaaaagaaauacgcauucaaacgcgaacacgccacaauccucgcgaacgucacccuccaggacgauuacggcagccucagcaccaaagcuauucggaaaaucuaccccuacauaaaagaaaaccaguauuccacagccugcgaaaaagcuggauacaaacauagcaaacuaucucucacgacagaggaacuagaggcccgcgaacucaagaacaucauuccccuucugaagaagaacgccuugcgaaaccccgucguagagaaaauccucaaccaaaugaucaacgucgucaaugcccuaaucgagaaaaacagugaaagggacgcugagggaaaaaucacgaaauacuuccacuucgacgaaauccggauagaacuugcaagagagcuuaagaaaaacgcccaggaacgauacgagaugacgcagaacauaaauaaagcuaaacuagaacaccagaagaucuccgggauacuccagaaggaguucggcauuaaaaacccaaccaaaucagacauaacacgcuaccgacuauaccaggaacuagcacacaacggcuacaacgaccuauacacaaauacuuacauacccaaagaacuccuauucuccaaaaacauagacauagaacacaucgucucgaaagcacgcguuuucgaugauuccuucucgaauaaaacacucgccuucagagaauuuaacaucaagaaaggagagucaacagcauucgauuauaucaccucgcuaaacaacgaagaggaacuaaaucaauaccugaacagagucgagaacgccuauaaaacuaaaaacaucucacccgcgaaauacaaaaacuuacugaagaaagccucggagaucggggacggcuucaucaauagggaccuccgcgacacacaauacaucgcgaagaaagccaaagagauucucuuccaaguaacgaaaaauguacucagcaccagcggaagcaucaccgaccgccuucgugaggauuggggccuugucgauguaaugaaagaacuaaacaugccaaaauaccagagccuaggccucaccgagguggaagaaagaaaggaggggaacaaaguaacagucaucaaaaacuggaccaaaagaaaugaccaccgccaccacgccauggacgcccugacugucgcguucacaaaacccuccuacauccaauaccucaaccaccuaaacgccagaaaagacaaaaauaacaagaacuacuccguaauccuugccaucgaggaaaaagagacaaucaaaguaccaaccaauaacggcaaaaauaagcgagucuucaucgaaccaauucccaacuuccgucaggucgccaaaaagcaccucgaagaaauuuucauaagccacaaagccaaaaauaaaguggucacuaagaauaccaacaaacccgcaggcaccgacaagcagcaaaucacccucaccccacgaggacaacuacacaaggaaaccguuuacgggaaauaccaauacuauguaaauaaagaagagaaaaucggcgucaaguucgacaaggaaacaaucgccaaagucucgaaccccguuuaccgggaagcccuacuaaagcgccugcaggccaacgacaacgaccccaagaaagccuucgcaggcaaaaacgcccucagcaaaaacccaaucuaccucgacgaagcgaagacaaaaacccugacggaaaagguaaaccugaccuaccucgaagaagacuucucaauacgaaaagauaucagccccgacaauuucaaggaccuaaaguccauagaaaagguaauagaccagggagucaaaagaauccucauuaagcgcuuacaagacuacgacaacgacccaaagaaggcauucgucgaccuggaaaagaacccgauaugguuaaacaaggaaaaagggaucgccaucaagagaguaaccaucagcggcgugaacaacgcgcaaccacuccauaucggaaaggaccaccuggggaagacuacccucaacaaggaagguaaagaaaucccagucgauuacgucucuacggguaacaaccaccacgucgccaucuaccgcgacaaagaaggcaaccuucaagagcagauagugagcuucuucgaggcaguagucggcgcccaacagggccucccaaucgucgacaagacuuacaaacaggcggagggcuggcaauucuuguucaccaugaagcagaacgaaauguucgucuuccccaacgaagcgacaggauucaaccccgcagaaauagaucugcuagaccccaagaacaaaaagcagaucuccccaaaccuauuccggguacagaaaaucgcaacuaaagacuacuucuuccgccaccaccucgaaacgaauguugacacagauaacguacucaaaaacaccacauggaagcgcgaaggucuuagcggcuuaaaagacaucguaaaaguucgcaucaaucaccuaggcgacaucguaaguaucggagaauacuga

SEQ ID NO: 6819 - RNA, 4284 nt, Artificial Sequence
  Cas9 variant
augaagaaaauucuaggccuggaucucggaaccucaucaaucggaugggcccuagucaacgaggcagagaccucagaggagaagucaagcaucaucaaacuuggagugagggucaacccccucacagucgacgaacuacaaaacuucgagaaaggcaaaagcaucaccaccaacgccgacagaaccgcuggcagaucuaugcgaagaaaccugcaaagguacaagcuccguagagaaaaccuaauagaaguccugaaagaguacaacuucauaaccgacgagaugauauuauccgaaaauggaaaucgcaccacguuugagaccuaccgacucagggcgaaggccgccguagaggaaauaucgcuugaacaguucgcccgaguucuccucaugaucaacaaaaagagaggauacaagucaucccgcaaagcaaaaggggcggagaacggcacccucaucgacggcauggaagucgccaagaaaauguaugacgaaggcaucacucccggcgaacucugccuacaacuacugacagccggcaaacgguacuuccccgacuucuaccgaagcgaccuccaagccgaguucgacaggauuuggaacuuccagaaacaauucuaucccgauagccugaucgacaaaguaaaagacgaagucagggggaagaacaaaucacaaacaugggcaauccucgcgaaguauuucgucuggaaagaaguagaaaacucuuggaacgaagaagaagcacaaacgcgccgagucgaaaaggaguacagacuugucggcaucaaacgaggagucaaaagagaggaacucaaauuggagaacuuccaguggcgaguaaaggcgcucucggaacgaaugaaccccgaggagcuggccaucguccuacaggaaauaaacgagcagaucucaaacagcucaggcuaccugggagccaucagcgaccgaagcaaagaacucuacuucaaccgccaaacggucggccaauaucaaauggccguacuugauaacaaccccaacauagggcuccgcaacauggucuucuaucgccaagacuaccuagacgaguuuaacaccauaugggaaaaacaagcagaguuccacaaagaacucacggaagaccugaagaaggagauacgggacauagugauauucuaccagaggcgccuaaagagccaaaaaggcuuaaucaacaucugcgaguucgaaagaagacaaauagaaguggaaauagacggaaagaagaaaaucaaaacuauaggcucccgagucauccccaggucgaguccguuguuccaggaguucaaaaucuggcagacgcucaacgacauagaagucagcguccucggcgucaaaaacaaacgcaagaagcaagaugacaacagcacaacgcuacucgacuccgccgaaaacauagacagucucaaacuaaaugucucgcgcccgcuagacgcggacgaaaaaucacuccuagcaaaggagcuguuuaucagggacaagcuaacaaagucagauguacuaaaacuucuguucaauaauccacaaaaccucaaccuaaacuuuaaaaacaucgauggcaaccgaacggggagcgcccuguaccaggcguucagcaaaauccucgaaauuucgggacacgaaagcauaaacuucaaaaagagcgccgacgagaucgucgagcagguaaaaacaaucuucucagccuuaggauggaacacagagguccucuguuuugacucagaaaaagagcuagacaaacaaccauacuucaaacuguggcaucuccuuuacagcuucgaaggugacuccacacccacgggggacggaaaccucauccaaaagaucgcggaccugugcggcuuugaaaaagacuacgcgagcaucuuagcgaacauuaccuuccaggaggacuacgggucgcuuucgaccaaggccauccgaaaaauccucccucacuugaaagacggaaaccaguacgacgucgccugcgaguacgcaggauacaaacacagcaaguccucgcugaaaaaggaagagaucaaaaauaaaguccucaaggacaaguuagagcuccucccaaagaacagccuacggaacccggucgucgagaagaucuugaaucaaaugguaaaugucaucaacgccaucaucacgaccuacggcaagccagacgaaauacgcaucgagcucgcaagggaacugaaaaagaacgcaaaggaacgagaagaacuaaccaaauccaucgucgacaccacaaagacccacgaagggaucagagcaauccuacaaaacgacuucggcaugucacacgucucgcgcaacgccauuauucgguacaaacuauacgaagaacuaaaagacaacggauacaagacccuguacuccaacacguauauaccuaaagaaaaacucuucucgaaagacuuugacaucgaacacauaaucccacaagcucgccuguucgacgacuccuucuccaauaagacguuagaagugaaaaguaucaacauagagaaagguaguaaaaccgcguaugacuucgucgaagaaaaguacggcgaacaaggacugcaagaguaccugaaccgcugcgaagugcuauuccgcgacaagaagacaaagcuccgcaaacuuaaaaugcaggagagcgaaauacccgaaggguucaucgaccgggaccuccggaacacgcaauacaucgccaagaaggcacucucuaugcuaaacgaaauuugcaggcgcgucgucgcgacaacaggggcuaucaccgacgaacuaagggaagauuggcaauugguggauguaaugaaagaacugaauugggaaaaauacaagguacucggucucguagaauacuucgaagacaacgacggccgauuaaucggacgaauaaaggacuggacgaaaagaaacgaccaccgacaccacgcaauggacgcccucaccgucgcauucaccaaggacgucuuuauacaguauuucaauaacaaaaacgccucacucaagccagacacaaaugaagcggcaauccgcaauaaauacuuccagaacggaaaagccaucccaccaaugagccuagacgaguuccgggccgaagccaagaaacaccucaacgacacacuuaucuccaucaaaaccaaaaacaaagucguuacaaucaaucuaaaccgaacaaagaagaaaaacggcauaaacaagaaacaacaacaaaccccgagaggccaacuacaccuggagacaguauacggcagccacaaacaauacguggucaaagaggagaaagucaacgccagcuucgacgcggcgaagauagccacagucaacaaaccagccuaccgcgacgcgcuacugcggcgacuacaagaaaacgggaacgacucaaagaaagcauuuacaggcaaaaacucccuagacaagcagcccguguggcuggacgcaaaacaaaacgaguguguacccgaaaaaguaaagaccguaaugcuagaaaccguauacacaguaaggaagcccaucgacgaaaagcugaacguagacaaggucguagacgccagaauacggaaacuacuacaagaccggauaaaagaguauggcaacgccaaaagcgccuucgcaaaccucgacgagaaccccaucuggcucaacaaggaaaaggguauaacgauaaagcgcgucagcgucuccggaauaagcaaagcacaaucccuccacgagaagaaggacaaagacgguaacuucauucuagacaaagacagccgucgcauccccguggacuucguaaauacagggaacaaccaccacgucgcaaucuaucgcaaacccgugcuagauaagaagggacaggccguguucgacgagaacggagaacuaaaguucgaacuggaagaagugguggucuccuuuuucgacgcgguaacgaggguuaaccugucacaacccauaauagacaaggauuacaaacgcagcgaaggcuggaaauuccuauuuuccaugaaacaaaacgaguacuucgucuucccaaacgaaaagaccggauucgaccccaaagaaaucgaucuccugaaucccgagaacuacgcgcuaaucucccccaaucuauucagaguacagaaaaucgcguccaaagacuacguguuccgacaucaccuagagacagucguagccgacagaaaagagcuccaagaaaucacguggaagcgaaucagcucacuguccauccugaaccgcauaauaaagguacgaguaaaccacaucgggcaaauagugaugaucggagaauauuga

SEQ ID NO: 6820 - RNA, 4284 nt, Artificial Sequence
  Cas9 variant
auggccaaaccaaaggacuacaccauuggacucgacaucggaacuaacagcguggggugggucgugacagacgaccaaaacaauauauuaagaaucaaaggaaagaaagcaaucggcgcuagacucuucgcagaaggcaaaguugccgccgaaagacgaaguuuuaggacgacccgccggagacuaagccgacgacgcuggcguauuaaacuccuagaagaacuguucgauaaagaaauagccaaaguagaucccagcuucuucgccagacugcacgaaucguggauauccccaaaagacaaaaggaaaagguacucagccauuguauucccgucgccagaagaagacaagaaauuccacgaaagcuauccuaccaucuaccaccuaagggacaaacucaugaaagaugaccagaaacacgacauccgcgagauauauauagcuguccaccaaaugaucaaggcccgcgggaacuuccuacaugacgaaagcguggaaaccuaccgcucgggaauguccucccucggcggacgcucggaacgcacgaucuugucggugcagacgcuggaagaauuaaacgaccuguuugcugaaaaugagggcaccgaggaggccaagcucaacgucgccucagcugagcagauuaacgacauccucacgggagggcaccuuaacgcagacucgcagaaagaaaucggcaaccugcuacuacccagcucguuccccucguucgaugacaaagcgaaggaaaagcaagucaagaaacugaucaaaaacguagcuacaaacauuagcaaagccuggcucggauacaaagcggacuucaguacgauacuaaaccuggcuaacguggacaaggaccaaaagaaaaucuucgccuucgcccuacaaggaggcgaugaggaagacaaaguccaagaacucgaaucccuccuggaacaaagucaaacagacauaguagaccgauuaaucgaaauccgacacgcgaucgucuuaagcgagaucgugcccgucggcaugacgcucagcgaggcuaugauugacaaguacgaccagcacaaggaagaccuuauuacccugaaagcaguaauacgaaauacaaaagacaaaaagaaagccgccaaauuacaagcgaucuaugaccuuuacguaaacaaccgucacgcggaucuugccaaagccaugaagcuaacugguaucaagaaacgaucagaacugcuggaccccgaagaacuaaagaaagcaaucagcaguuuacuagacgacuccccagaagccgucgaaaucaaacagauguuagaggagaagacauuccuuccgcuacaacggucgaacaauaacggggucauccccaaccaacugcaccagguggaacuugacgagaucauuaaaaagcaaagcaaguacuaccccuuccucgccgaaaagaacccugacgaaucggaagaggcacagaaaaaggcgccaacaaaguuggacgccuugcuuacauuccgagucccguacuacguaggacccaugauaacgaaggaggaacaagaagcccaagacggccacucguucgcauggaugguaaggcgcgacccacaagaccacgaggccauaacacccuggaacuucgaaaagaaaguggacaaaauggcaagcgccacccaauucaucaaacgaaugaccaccaaagacaccuaucugcucggcgaagacguccuccccgcuagcucacuaaaauaccaguuauucaccguccucaacgagcucaauaaucuacgggucaauggaaagaaguuaaccagcgaugaaaaagaacaaguaaucgaggggcuauucaagaaacagaaaacggucaaagccgacaaauucgucaaguacuggcaagcaaagcacauaggcgcagacaucaaaguaaagggccuauccgacccaagcaaguucaacagcaccauguccaccuacauagacuucaagaaaauauucggcgaccagcucaacgacgucaaucgccaaaacgacuucgagaaaauuauagaauauucaacgauauucgaagaccgcaaaauucuagaagacaaacuacgggcggacuucgccuggcuaucagaagaacaaaucaaacagcucugccgccuccgccuucaaggcuggggccgucucagcgacaaacuacucacgcgccucacagacgcggacggacagaacguacuugaacggcuguggaacucuaacgacaacuucguacaaaucguaucagaccccaacaucaaggccaagaucgagcaggagaaccaaaagcugcuacgcgacggacaaagcgacgacgccguggaaucgauccuggaugacgccuacaccucgccccaaaacaaaaaggcgauacgccaaguaaugcgagugguccacgacaucguaaaggccugcgacggaaacguaccggcuaaauuugcgauagaguucgcccgaucccaagaagacgaccccaagcgcacaacagccagagucaaccagaugcagaaaauuuacgaccaaaucuccgacgaagucgucagccaaggcgucaaagaacaacucagcggaaugaaaucccucaaagaccgguacuaccuauacuucaugcaaggcgggcgagacgcuuacaccggggcaaaacucaacaucgacagguuguccgacuacgauaucgaccacaucaugccccaaucuuucguaaaggaugacagucuggacaaccggguauuaguagcacgcgccguaaacaaccagaaaagcgacaaaguccccgcacuacuauuuggcaacaaagugguagcagaucuuggcauaacgguccgcgaaaugugggacaaguggcaaaaacucggaaugaucagcaaacgaaagcuaucaaaccuccucaccgacccggaugcccuaacugaauacagggcccaaggcuuuauucgcagacagcuaguagagaccagccaagugaucaaacuaacugcgaccauacuccaaagcgaguuccccgacucgaagaucaucgaaguuccagcuaaauacaacagcauugugcgaaagcaauucgaccucuauaagucccgcgaaguuaacgacuaccaccaugcaauagacgccuaccucucgacaauagucggaaacuaccucuaccaaguauacccgaaccugcggcgcauguucguguacggugaguucaaaaaguucagcucgaacgcugaagaauccgccuacgacguaguacgacgaguuaagucaaugaacuuccucgaugaccuacuacgggggacacacggcgacaacaucuacugcagaaguaccggagaaaucguauucaaccgaaacgacaucaucucaaaacuaaagcaagccuacuccuucaaacaaaugcucguuacacaagaggucuucaccaaaaagucugcccucuucgaccaaacaguuuacccaucccccgagagggacuccaagaaaagauccgggcucauaccccgcaagaaaggaauggacaccgagauauauggcggauauuccggaaacaaagacgccuacuucguccucgccgaagccguaaaagaaaaagggcacacccuccagauugugggaguaccgauccgggcccucaacacacugaaaaacagcgcgaacuacagcgaaaaacuucuagaaaucauaaaaccgcaaguaauguucaacaaagauacgggcaaacccaucaaaggcaucaaggaugucaagauacucauggauaaaauaccaugcagacaaccgguacucgaaggcgaguccuauuacaugcucgccucaucaaaauaccgcuacagccucaaacaaauaucgcuaagccaaaugucgaugaaauacauacuagacuacaucgacgacccgaauuucaacaaacacgaaaugauaaacaucgaccaacaggacgagaaagaaugccuucucagcguauacgacgaaauccucgagaaaauggacaaauaccuaccacuuuucgauauccgcagcuuccgaaagaaacuccacgacggacgcgacgcauucauagcacuccccguggcaucugaagagaaaaagccaggaaaaguagacgucauccgcaaaguacuaaaggggcuucacgcaaacgccgauaucacuaaccuggccgaacuaggauucggcaccgcagcacugggcgcacucguauccacgggagggaucaaaauuuccgaugacgcaguauucaucuaccaaucaccaacugggcuguucgaacggcgagucaaggucuccgaccuacuaaaauga

SEQ ID NO: 6821 - RNA, 4287 nt, Artificial Sequence
  Cas9 variant
augaagaaaaucuugggccucgaucuuggaacgacaucaaucggaucagccuacgugcuggaagccgaaaaaucugcagaacagaccaaaauagucuaccucggcacacgcaucauacucagcucagcggacgcagaaaacuucuccaaaggacuaagcugcagcccaacaacagaucgcaccuuuaagcgauccaugcgacggcgacuacagcgcuacaagcagcgacgaagcucauuaauacaacaauucaagaagaucggaauaauaacaaacaccgaacaaaucauacgagaaccaauaucggagacccacgagcuccuccggaucaggagcaaagcaguuagcgagcgaguaagccucgaagaguucgcacgaauacuccuaacaauuaacaaaagacgcggauacaagagcaaccggaagacguccaaguccacugaagaagacggcaagcucguggaugcgauggccguaaccaaagaacucaucaaacugaagaaaaccccuggucaauacauguucgagcgcuucaaacgcggcaaauacgccgaaaucgacuucuauccauucgacuuaaucaacgaacucaaacaaaucugggaaguccaagggcaaaaauacccagauguccugaccgaagacuuacuaagcucgcuacuaaagcagaaaaccggcaaagccaaagagcugauauacagcaaaagcgaccugaaccccgcagagguuccuauagacuaccaaaagggcaagaaacuccgcaaaaccauccucaacaaauauuucgcguacgagagccguucccucgccgcgaccaacauaauccccgucgaacaagugaucacagccaucguggcaaucugcaaacaaauuaacaacagcuccggauaccucggcgcgaucggcgaccgcucucgcguccucuacgcaaacaaucaaacaaucgggcaauaccuauacgagcggaucaaagcaaacccccacgaucguauccgcggagaaguauuuuaccggcaagacuaccucgacgaguucgaccggauaugggaaugccaacaaaacuacuaccccgccauacucacaaacgaccgaaaacaauucauucguaacagaaucaucuucuaccagcgcccacucaaauccaagaaaucugaacucgccuucugcgaguucgaaucacgagaaguggaacacaacgggaaaaaguacacggaaggacuccauguagcccccaagagcagcccgguauuccaacacuuccgucuguggcagcgccugggucaaaucgaagucucaccccucagaaaguggaacaaacaauccaaugaacuguuugagcaacagaacgacaccgaccaggaaagaauacucaacaccgaagccaagcagaaacuauucuccuaucugaacuugcuagaucacuugacggacaacgaaauacucaacauccuaggguacucgccggacaaauggaaaaucaacuuccgggagauaauagguaaccgaaccaacaacagcaugaugaaagccuucuucaacaugaaggaaaugacugacggcgaacagaucaauugggagaaaaaccuaaccaaaaucacgaacggccaaucacuaauaagccccgaacagauaguagacuuaauucgacaauuuuucgaacgagaaggaaucacaaccagccuacuauacuucgacccuacuaccgacaacuuccgcgaacaaucgcacuauucccucuggcaccuacuauauuccuacgaggacgacaacucaccgacagguacaaccagccucugcaagacacuagccaaacgcuacggcaucccccacgaacucugcccacuacuagccagcuuaacuuucgaaccccaauacgguucguuaaguacaaaggcuaugcgaaagauccuacccuucaugcaagaaaacggcuacgacaaagccugcgaacucgcagguuaucgccacuccgcguggaccacgaaggaagagaacaccgaacgcacguuaaagaacucccucccccuccugcgaaagggaucacuacgcaaccccguaguagagaaaauccucaaccaaaugacacacguaauaaauacccacaucagugaauauggaaaccccgacgaaauacguaucgaaauggcccgagacaugcaagcaaacagcaagcaacgaaaagcaaugacgacugccauagcagaggcuacuaagcgaaacacucaauucaucgaggagauacaaaaagaguucggguuuaauccauccaaaaacgaccucauaaaguacaagcuguggaaggaacuagcuccccuagggagcaaaacccuauacagcaacaccuacauuccgaaagaggaacucuucacugccaaauucgaaaucgagcauauaauaccccgugcccuguuuuacgacgacagcuucagcaacaagacucuagaacucaacagcguaaacaagcucaagggcaacaaaacagcgcuagacuacauggacacucucucccaagaacaggccaacgacuacaucauacgcguagaggaacuuaagaaaauaggcgccaucacccaagcgaaauacaaaaagcuacuaaucagagagaaggaccugggcgacgacuucacaaacagagaccuaaccaauacccgcuauaucauacgacacgcagcagacaugcuucuacaagucaccccaucaauaguucacacaaacgguucgaucacugccauacuaagacgagacugggaacuacuugauauacuuaaagaacugaaucugcccacauaugagucgauugaccgcaaaaucuccgaccccaaagaaaaacuaacggagaguguggaaagaaaggacggccaagccaucaagaugauaaaggacugguccaaacgcgacgaccaucgccaucacgcuauggacgccuugauaaccgcacucaccacucgaaagcauguccaauaccucaauggaaaccgaggagccgaagagaccgauaagguucagaagcuccaacaacuaaaggcccugcgaaaacagcucauuggcucagacgggcauuucauacccccaaugcacgacauaagaguacaagccaaggaggcgcucuccaggguaaucauuagcacaaaagcaaagggcaaagugacuacgcccaauaccaacauaauuugcucgcgagacaagacuacuggccgaaaaauauacgucaaacaaacaacccucacgccaagaggcgcccugcacaaagaaaugcaauacgguugcaaccauuacuaccuagaaaaacaaauacccaucggcuccaaacuaacagaagaagagauccgccucgugucuucgccaaaaauccgguccaugcugagcgaacgcuuacaagcguacaacaacgacccaaaaagcgccuucaccggccggaacuccauggacaagaagccacucgaagacaaaaacaaaaagcuagucuacacggacaagaaagucaaacaaaccauccuugcaaaccgauucgucaagcgcgaccgaguuaacuccaaacuggaccuagacaaagugaucgauacaggcauaaagcgaauccucgaaagacgccucaaacaauacggcggaaaauacgagacggccuuuuccgaccuagaaaauaacccaaucuggcuaaacgaagaaaaaggcaucgcgauaaaguccguaagaauccgcggcaaaaacaacacaaucacaauacggcaaacgaacacuugccggauaaaguacguugccaacgacaacaaccaccaccucgccguguacgcccuccccgacggauccauagaagacgacauugucagcuucuucgacgcagucgaacgcagccgcaaaggccuccccauaaucgacaagcauaaaaaccaaucacucggauggaaauuccuuuucucuguaaagcaaaacgaauacuuccuacucccccagcagggcgagaaaauagacauagacacuggcgaaauuaguaugcagacaacuuucucacccaaggaucucucccccgaauacauaaugaauccagacaacuacgccgagcucgcaccccacauauuccgcguccagagcauauccaaaacuccccaaggaaaccgagacguaagaaucuaccuuuuuaagcaacaauacauaagcgggucccaaaaagacucacuccaucuuaagggaaucacccaccgacaaaucucaagcgccaaagaccucgccggucuggucaagauccgcgugaaccaucuggggcguaucguagccgucggggagaaauga

SEQ ID NO: 6822 - RNA, 4287 nt, Artificial Sequence
  Cas9 variant
augaagaaaaucuuaggccucgaucugggcacagccucaauuggcagcgccuauguccuagaggccgaaaaaucagcggaccaaaccaaaauaguauaucuagggacccgcauaauccuuuccuccgcggacgcggaaaauuuuuccaagggacuauccugcuccccgaccacugaccgcaccuuuaagagaucuaugcgccgccgccuacaacguuacaaacaacgacguaguucccuuauucaacaguucaagaaaauaggcauaauaaccaacacggaacaaaucauucgagaaccaaucuccgaaacccacgaacuccuccggaucaggucgaaagccguaucagagcgcgucucgcuggaggaguucgcccgcauacuccucaccaucaauaagcgccgcggcuauaagucuaaucgcaaaacaaguaaauccacagaagaagacggaaaacucguggacgcaauggccgucacaaaggaacucaucaaacugaagaagaccccggggcaauacauguucgaacgauucaaacgcggcaaauacgcagaaauugacuucuaccccuucgaccucaucaacgaacuuaaacagaucugggagguccaaggacaaaaauaccccgacguacugacggaagaccuccucucaagccuccucaagcagaaaacaggaaaagcaaaagaacucaucuacaguaagucagaucucaaucccgcggagguaccgaucgauuaucaaaaaggaaagaaacuucggaagacgauacuuaacaaguacuucgcauacgaguccagaucacucgccgucaccaacauuaucccggucgaacaagcaaucaccgccauaguagccauaugcaagcaaaucaauaauucaucaggauaccucggagcaaucggcgacagaucccgaguauuauacgcuaacaaccaaaccaucggucaauaccucuacgagcgaaucaaggccaacccgcacgacaggauccgcggagaaguauuuuaccgucaagacuaccucgacgaguucgaucgcaucugggaaugccaacaaaauuacuaccccgccauccuuacuaacgaccgcaagcaauauauccgcaaccgcaucaucuucuaccaacgcccccucaagagcaagaagagugaacucgccuucugcgaguucgaaagccgcgaaguugagcacaacggcaaaaaguacaccgaaggccuacaugucgcaccaaaaucauccccggucuuucagcacuucaggcucuggcaacgccucggccaaauagaagucuccccauuacgcaaaugggacaaacaaagcaacgaguuauuugaacagcaaaacaacgcagaucgcgaaggcauucucaacacagaagccaaacagaaacucuucagcuaccucaaccucuuagaucaccugacggacaaugaaauacugaacaucuugggguacuccccggacaaauggaagauaaacuuccgagaaaucauagggaaccgcacuaacaaccucaugaugaaagcauucuucucaaugaaagagaugaccgacggagaacaaaucgacugggaaaagaaccuuaccaagauuacaaacggucagucacucaucaguccugagcagaucgucgaccuaauccgacaauuuuucgaacgagaaggaauaacaacaucccuccuauacuucgacccggccacagauaacuuucgagaacaaucccacuacucccuauggcauuuacucuacucauacgaagacgauaauuccccaaccgggaccaccucacuuugcaaaacccucgcgaagcgcuacgguaucccgcacgagcuaugcccccuccucgccagucuaaccuucgaacgccaguacggcucccuauccacaaaagcgaugaggaaacuccuuccguucaugcaagagaaacgcuaugacgaagccugcgaauuggcuggcuaccgacacuccgcguggauaacuaaagaggagaacgccaaacgaacgcucaagaacaaacuaccccuccuucgaaaaggcagccuacgaaaccccgucgucgagaaaauccuaaaccagaugacucacguaauaaacacccauaucgccgaauacggcaaccccgacgaaauccggaucgaaauggcccgcgauaugcaagcaaacuccaaacaacggaaggccaugacggccgcaaucacagaagcuaccaaacgcaacacucaauucaucgaggaaauccagaaggaguucggauucaacccguccaaaaacgaccuuaucaaauacaaacucuggaaagaacucgcgccucucgggaacaaaacacuauacagcaacauauacauaccaaaagaggaacucuucacagccaaguucgaaauagaacacaucauaccacgagcccuuuucuacgacgacucguucuccaacaaaacacucgagcuaaacucugugaacaagcucaaggguaacaaaacggcgcucgacuaccucgacaccuuaggccaagagaaggccaacgacuacauccuacggguagaggaacugaaaaagaucggcgcaaucacucaagccaaauacaagaaacuccuaauucgcgaaaaagaucucggggacgacuucaccaauagggaccugacgaacacgcgcuacaucaucaggcaugcggccgacaugcuccugcaaguaaccccaagcauuguccacaccaauggauccauaaccgcuauccuucgcagagacuggggccugcuugacauucuuaaagaacucaaccuaccuacauacgaguccauugaccguaaaauaucugaccccgaagaaaaacucacccagucaguagaccgcaaagacggccaggcaaucaagaugauuaaagauugguccaaacgggacgaccaucgucaccacgcuauggacgcgcugaucaccgcccugacaacacguaaacacguccaauaccucaacggcaacagcggcgcugaagaaaccgacaaagcgcagaaacuggaacaacuuaaagcgcuccgaaaacaguuaaucggcucagacggacacuuuauacccccgaugcacgacauccggguucaggccaaagaagcguugucccgaguaaucaucagcaccaagguaaaaggcaaaguaaccaccccgaacacgaauaucaucuguucacgagacaaaacgacgggccgaaaaauauacgucaggcaaaccacacuuacgccgcgcggagcccuacaccucgacacaaaauacggaaucaaccgauacuaccaagaacgagaaguuuccaucggaucaaaauuaacccaagaagaaauccggcuaguauccucgccccacauccaguccauucuacuagagagacuccgcgccuucgacaacaaccccaaaagugccuucaccggacgcaacucaguagacaagaaaccucuggaagacaaaaauaagaaacucguguacacagacaagaaaguaaaacagacgauccucgccaaccgauucgugaaacgugaccaaguaaauuccaaacuuaaccucgacaaaguuaucgacacagggauuaaacgcauccucgagggacggcuccaacaauauggcggcaaguacgagaccgcauucagcgaccucgaaaacaacccuaucuggcucaacgaggagaaggggaucgcaaucaaaaguguacgaauccgcggcaaaaacaacgcuauacccauacaccaaaccgacacaugccccauagacuacguagcaaacgacaacaaucaccaccucgcagucuacguacuaccggacggcaccaucgaggacgauaucgucaccuuuuucgaugcggucgaaaggucacgccagggacugcccaucguugacaaaaacaaaaaccagucccucgguuggaaauuccucuucuccaucaagcaaaacgaguacuuccuacucccacagcaggcggaaaagauagacaucgacacgggagaaauaagcacccaaaccacuuucucuccaaaagaucugucaccugaguacauaaugaauccagacaauuaugcagaacuugccucccacauauucagagugcagucaauauccaaaaccccgcaaggcaaccgagacguacgaauauaccucuuuaagcaacaauauaucaguggcucacaaaaagacucgcuucaccucaaagggauaaccuaccgccaaaucucuuccgccaaagaccucgcugaacucgucaaaaucagagugaaccaccuaggaaggaucguaucagugggagaaaaauga

SEQ ID NO: 6823 - RNA, 4287 nt, Artificial Sequence
  Cas9 variant
augaccaaaaagauccuaggccuagaccucggcacaacaagcaucggaugggcguacguaaucgagagcgacaauccagacgagagcgaaaucaagcaaauaggcguacgcgucaacccccucacgaccgacgaacagaccaacuuugaaaaggguaaaccauuuagcauaaacaaagaacgaacacuaaagcgcggagcacgacggaaccuggaccgauacaaagacagacggaacaaccucaucgaagugcugaaaaaggccaacauccucucccaggacagcauccuaacagaggaagggcagcacacgacccaccaaaccuggcaacugcgagcaaaggcagcagucgacaaaauagaaaaagaagaacuugccagagugcuacuagccauaaacaagaaaagaggguacaaaagcucaagaaaagccaaaaacgaggaugaaggucaagccauagacggaauggccgucgcgaagcgccuauacgacgaacaaauaaccugcggacagcucgucuaccagcuucuccgggagggcaaaaagagcauccccgacuucuaccgaagcgaccuccaagccgaguucgacaaggucuggaacuuccagaaacaguucuaccccaaaauccucaccgacgaauuuuacaaagaacucaaaggaaaaggccaacgggccacuucagcacucuucuacaaaacauacaacuucaacacggccgaaaauaaaggauccagagaagagaagaaaauccaagccuacaaauggaggagcgaagccauaucucagcagcuugaaaaggaagaaguagcuuucguucuuacggaaaucaacaacaaccuaaacaacagcagcggcuaccugggcgccauaagcgacagaaguaaggaacuauacuucaacaagcaaaccguaggacaguaccucuaccagcaacuacaagaaaaucggcacgcccgacugaaaaaccaggucuucuacagacaggacuauuuagacgaguuugaagcuauuuggaaagagcaagcgaagcaccacacagagcuaaccgaggaacuaaaggccgaaauaagagacaucaucauauucuaccaaaggaaacucaagagccagaaaggccuuaucaguuucugcgaguucgaaagccgagaaauucagaucgacggcaagaagaaaacgauaggacuacgaguagcgccaaaaagcaguccccuuuuccaagaguucaaaaucuggcagaaccucaauaacguccuaguaagaaagaaaggcagccgaaaaagaaacgucaaacaagaaauacaaggcucccucuucgaggaggaaaaagaaaucuucgucuucgaccuagaaaccaaagaaaaacuguucgaggaacuaaaccucaaagguaaccucuccgcaaacaaagucauugagcuccucggacacaaaccaacagagugggaaaucaauuauuccgccuuggaaggaaaccgaaccaaccaagcccucuacaacgcauaccugaagauacuagacauagaaggauacgacgaggaccugcuaaaacucagcgacaaggacgauaucaacgucgcagacuuaaaaacgccggccuccgagauuaaaaacaugguacgggacauauuccaaguguuagggaucagcaccgacauacuagaguucgacgcagaacuggacggaaaggacuucgagcagcaggccucguaccagcuauggcaccuccuguauagcuacgaaggcgacgacucacaaagcggcaacgagaaacucuacgagcuacucgaaaagaaauucggauucaagaaagaacacucgcaaguccucgcaaacgucacacuauccgacgacuacggcaaccucaguagcaaagccaugaggaaaaucuaccccuucauaaaagaaaacaacuacagcaccgcgugcgagcuggcaggcuaccgccauagcaaacacucccucacaaaagaagagaucgagaaccgaccacuagacgacaaacuagagcuccugaagaaaaacucacuaaggcagcccguaguggagaaaauccugaaucaaaugguaaacguaguaaauucacuucucgagaaaaaucggaaagaaaauccagacuuccgauucgacgaaauccgcaucgaacuggccagagaacuaaagaagaaugcgaaagaacgggcagaaaugacuacaaacaucaacagcgcgaaaacagaaaacgaaaagaucuucaaacuacugcaagcugaguucggacucaaaaaccccaccagaaacgacaucauacgauacagacucuaugaagaacucaaaaacaacggguacaaggaccuauacaccaauaaauacauaccccgagaaauacuguucagcaaacaggucgacaucgaacacauaaucccccagagucgguuguucgacgacuccuuuagcaauaaaacaauaguguaccgagaaacuaaccucgacaaaggaaaccaaacggccuucgacuacaucgacagcaaguacggcaacgaaaaaguggaagaauacauccucaggaucgaggcucuccacgacgcauggaagaaaaacaaggaagaaggaauaagcaaggcaaaauaccaaaaacugcucaagaaggagacagagauaggagacggauucauagagcgcgaccucagagaaagccaguacauagcgaaaaaggcaaaagagauguuauucaagaucacccgaagcgucgucagcaccagcggcucgaucacggacaaacugcgcgaagacuggggacugauaaacaucaugaaggaacucaaccugccaaaauaccggucccuggggcuaaccgagaugcaggaacgcaaguuuggccagaaagucgaagucaucaacgacuggaccaagaggaaugaccacagacaccacgcgauggacgcacucaccgucgcauucaccaaacauaaccacauacaauaucucaauuaccuaaacgcgcggaaaaacgagaaccauaaacugcacaacaauauaaucgccauugaaaacuuagagacagagacgaugaucgacaacaacggcuccaaacgacgggucuucaaagcgccaaugccaaauuuccgacaaguugccaaagagcaccuggagaacguucuaauaucgcacaaagccaagaacaagguggucaccaagaacaaaaacaaaauagcuggcaaagucgcggcacaagagacacugacaccccguggacaacuacacaaagagaccgucuacggcaaauaccaauacuacguaaacaaggaagagaaaaucgggacaaaauucgacgaagaaacaauuaacaaagucagcaacccacaguauagaaagcugcuucucgaacgacuaucggcgaacgggaacgacccgaagaaagcauuuuccggcaaaaacgcacucagcaagaaccccauauaccugaacgaaaccaaaaccgaaacgguaccggaaguaguaaagcugacauggcuagaagaggacuacucuauccguaaagacauaacgcccgacaacuucaaagacgagaagucaauagacaagauucuagacgagggaguuaagcgaauacucaaaaagcgccuacgcaaaaacgacaacgaccccaagaaggcuuucucagacuuagacaaaaacccuaucuggcucaacgaagaaaaagggaucagcaucaaacgcgugacaaucuccggcguaaacaacgccgaaccgcuacacuauaagaaggaccacuucggcaacgacauacucgacgagaagggagauaaaaucccaguagauuucgucucaacgggcaauaaccaccacguugcaguuuacagagacgaaaaaggaaaccuccaggagaauauagucucguuuuucgaggcugucauccggguaaaccaggggcugcccauaauagacaaagccuacaaccaacaccugggauggcaauuccuauuuaccaugaagcaaaacgagauguucgucuucccgaacgaaaaguccggcuucaacccacaggaaauagaccucuuggacccaucaaacaagaagaagaucucgcccaaucuauuccgcguacagaaaauguccaagguaaucuacggaaacucgcccguuagggaguacguguuccgucaccaucuggagacuaacguggacgagaaaaaggaacuaaaggacauaaccuucaagaacauaaagucccucgguuacuucgaagacauaguuaaaguuagaaucaaccaccugggcgacaucgugucagucggcgaguacuga

SEQ ID NO: 6824 - RNA, 4293 nt, Artificial Sequence
  Cas9 variant
augaaacacauacucggccucgaccucgggaccaacucgaucggcugggcgguagucaaagaagcacaaaacgacaaugaacaaucggaaaucguagacgucggagugcgcgugaacccgcuaacaacggacgaaaagaccaacuuugagaaaggaaagccuauaucgaccaacgccgaccgaacacucaaaagaucggcgcgacggaaccuccaaagauacaaacuucgacguaaagaacuaauagagcuacucaaggaacaccaacuaaucuccacugacacaauccuaaccgaaaacggcaaaggaacgacauuccaaacacucgaacuacgugcgaaguccgcaaaagagaagauaagucuagaagaacuagcaagaguauuccuuacgaucaacaagaaacggggcuacaagagcucgcguaaggcaaagaacgaagacgaaggucagcucaucgauggcauggaaaucgcaaaaagacucuacgaagaaaaccucacgacagggcagcugagccuccaacugcugaaagaaggcaaaaagagcuuacccgacuacuaccgcuccgaccugcaauucgaacuagacaaaguguggaacuuccaaaaacaauuccacuccgacauacuaaccgacgaguucuacgcacagcugaaaggcaaagggcaaagagccacauccgcccuuuuccucgcaaaguaccaaaucuacacagccgaaaacaagggaagccgcgaagacaagaaacuucaagccuaccaguggcgcguggaugcucuaucgaaagaacucacccgcgagcagcuagccuucguaaucaccgaaauaaacaacaaccuaaacaacagcucgggguaccucggcgccaucucggaucgaucgaaagaauuguacuucaacaacgagaccgucggagaauaccuuuggaagcagauagccgccaacccacacaccagccucaaaaaccaggucuucuauagacaagacuaccucgacgaauuugagcaaauauggaagacccaaucagccuucuacccggaaauccuuacagacgaacucaagaaagagcucagagacgucgucaucuucuaccaaagaaaacugaaaucccaaaagucucuagucagcuucugugaguucgagaacaaggaaauagagauaaagaaagaagacggcaccucgacgaaaaagguaaucgggcugaaggucgccccaaaauccagcccccuuuuccaagaguucaaaauauggcaaaaccucaacaauguacuuauacggaagaaaggcagcaaaacaaagaaaguugccaaaaaucaacaggcaguauuauucgaagaagagaaaacgaucagcgaacucgaccucgaagcaaaacaggcacucuucaacgaacuaaauuugaaagguaaccuaaaggcggacuacugccucgagauacuaggcuacagccccaaagagugggagaugaacuacagcguacuagaaggaaacaggaccaacaaagcacuauacgaagcauaccugaaaaucaccgaucucgaaggguacgacgccaaaaaccaccucaaagucaaacugaacaaggacgaggucgagcucgacgaccuaaaaguuccggcaagcgaaauuaaggacaugguccaggcaauauucaaagaggcaggaauaaacacagacauccuccacuucaacgcagaacuugacggaaaggacuucgaaaaccaggccucauaccaacuguggcaucuccucuauagcuaugagggagacgauucaaagucagggaacgagcuccucuacaaacuccuagaaaccaaguuugguuuuaaaaaggaguacgcccaaauacuagccaacguuagccuaagcgacgauuacggcagccucuccacgaaggccaugcgaaagauacaccccuacaucaaagaaaauaaguucucgacagccugcgaacuagcaggcuaccgccacagcaagcacucacuaaccaaggaagagaacgacaaccgcgugcuaaaagacagcuuggaaguccuaaagaaaaacagccuccggcaacccguaguagagaaaauccuaaaccaaaugauaaaucucgucaacgcccuacuaaagaaguaucgcacagaaaauccaaacuucaaauuugacgaaauccgcaucgaacucgcccgcgaacucaagaagaaugcggaagaacgagcgaauaugaccgcgaacauaaauaaggcaaaaaccgaacacgaaaagauaauuaagauccugaagaaugaguucgggcugccaaaccccacacgaaacgacauaauccgguaccggcucuacgaagaacugaaggccaacggcuauaaagaccuauacacaaacauaaagauuccccaggaaaaacuuuucaccaaagaaauagacauagaacacaucaucccaaagagccgaguauucgacgacucguucucaaauaaaacgcuuaguuuccgcaaaacgaaccucgacaagggcgaacgaacagccuuugacuacauggaaagcaaguucggcgcagacaaacuugaagaguacgucgcccgagucgaagaccucuacaagaacaacaucaucuccaaggccaaauaccagaaacugcuuaagaaggaaucggagauaggcgacggauucguggagagggaccucagagaaacccaguacaucgcgaagaaagccaaggaaauccuacuccagaucacgcccaacguacugaguacgucgggcgggaucacggaccgccugcgggaagacugggaccuaauuaaugugaugaaagagcucaaccuaccaaaguaccgagcccuuggguuaacccaaauggaagacagaaaguacggccagcaggucgaagucaucacagacuggacaaaacgaaacgaccaccggcaccaugcaauggacgcucuaaccgucgccuucacaaaacacaaccacauacaauaccuuaacuaccugaacgcgcguaaaaaugagaaacacaaggagcauagcaacaucauggguauucaacaacucgaaaccaucaaggucaccgacaagaacggaaacgaaaagcgugucuucaaggcaccgaugcccaacuuccgccaggugaccaaggcauuccuggagaacauacugaucucacacaaagcgaaaaacaaaguggugaccaaaaacaaaaacaaggucgcaggcagcaauaaaguccaagaaguucugacacccaggggucaacugcacaaagagaccgucuaugggaaguaccaauacuacguacaaaaagaagaaaagauaggugccaaauuugaucuagaaaccaucaagaaaguagcaaaccccuuauaccagagcuuacucaaaaagcguuuagaggaaaacggaggggauccgaaaaaggccuucacgggcaagaauagccuagccaaaaaccccauauaucuagacgacacacaaacagaacaacuaccagagaaagucaagcuaguuuggcuugaaaacagcuucucaauccgcaaagacaucacuccagaaaacuucaaagacgagaaacucaucgacaaaaucuuggaugagggggucaagcgaauccugaaggaacgauuacagagcuuugggaacgacgccaagaaagcauucuccgauuuagacaaaaaccccauauggcuaaacaaggagaaagggaucacaaucaagcgagucacaaucagcggcguagccaaugcugagccgcugcacaccaagaaagaccaccuaggcaaagaaauauuagacaaagaaggcaaacccaucccuguagacuucaucagcaccggcagcaaucaccauguggcaguuuaccgagaugaaaaaggaaauuuacaagaaaaggucguaucgguauuugaagcggucguacgcgcgaaccaaggacuaccuaucaucgauaagaccuacaaucaacaccucggcugggaguuccucuucacaaugaaacaaaacgaaauguucgucuucccaaacgagucgacgggguucaacccaaacgacauagaccugcuagaccccaagaacaaacgcauaauaagcccaaaccuauuccgcguacaaaaguucucaaaacuccaauacggcaacagcuucgugcgcgaguucguguucagacaccaccuagaaaccaccguagaagaccgcaaagaacuacaagggaucacauacaaacaaaugaaaaacucgaccuucuucaacgauaucaucaaagugcgaauaaaccaccuaggcgacaucgucucaaucggggaauacuga

SEQ ID NO: 6825 - RNA, 4293 nt, Artificial Sequence
  Cas9 variant
augaaacacauccuaggccucgaccuaggaacaaacucgauaggcugggcaguagucaaggaagcccaaaacgacaacgaacagagcgagaucguggacguaggaguaagagucaacccccuaaccacagacgagaaaaccaacuucgaaaaagggaaacccauaucgaccaacgccgaccgaacacucaaaaggucugcacgccggaaucugcaaagauacaaacuccgccgcaaagaacucaucgaguuacugaaagagcaccagcucaucagcaccgacacgauccugacggaaaacggaaaaggcacaacauuccaaacccucgaacugcgggcaaaaagcgccaaagaaaagaucucccucgaggagcuggcacgcguauuccugacaauuaacaaaaagcgcggauauaaguccagccgcaaggccaaaaacgaagacgaaggccaacuaauugacggcauggaaaucgcaaaacggcucuacgaagaaaaccuuacgaccggucagcugagccuccaacuacucaaagaaggcaagaaaagccugcccgacuacuaccggucagaccuacaauucgaacuugacaaagucuggaacuuccagaaacaauuccacagucacauccucaccgacgaguucuacgcccaacucaaaggcaaaggccaacgagcgacaagcgcgcuguuccucgccaaguaccagaucuacaccgccgaaaauaaaggaagccgagaagacaagaaacuccaagcauaccaauggcggguagacgcacugagcaaggaacugaccagggaacaacuagccuucgucauaacggagauaaacaacaaccugaacaacagcagcggauaccucggagcuaucagcgaccgcucaaaagagcucuacuucaacaacgagacagucggugaguaccuuuggaaacagaucgcggcaaacccccacaccagccucaaaaaucaagucuucuaucgccaggacuaccuugacgaguucgaacagaucuggaagacacagagcgcuuucuaccccgagauacuaaccgacgagcuaaagaaagaacugcgggacguagucaucuucuaccaaagaaaacucaaaagccaaaaaucacuggucagcuuuugcgaguucgaaaauaaggagaucgagaucaagaaagaggacgggaccagcaccaagaaagucaucgggcuaaaaguggcucccaaaucgagcccacucuuccaagaguucaaaauuuggcaaaaccugaacaacguccuuauucgcaagaaagggagcaaaacaaagaaaguggauaaaaaccagcaagccguacucuucgaagaagagaaaacaaucuucgaauuagaccucgaagcaaaacaagcacuauucaacgagcucaaccuuaaagggaauuuaaaagcauacuacugccucgaaauccugggguacucgcccaaggaaugggaaaugaacuacucaguccuagaagggaacagaacaaacaaagcccuauaugaagccuaccuaaagauaacugaccuagaaggauacgacgcgaaaaaccaccugaaggucaaacuaaacaaggacgaaguggagcucgacgaccucaaggugcccgcauccgaaauaaaagacaugguacaagccaucuucaaagaagccggaauuaacacagacauccuacacuucaacgcagaacucgauggaaaggauuucgaaaaccaagccagcuaccagcucuggcaccuccuauacagcuaugagggggaugacuccaagaguggcaacgaacuacuguacaagcuccuggaaaccaaauucggguucaagaaagaauacgcacaaauccuggccaacguuucccugucagacgacuacgggucgcuauccaccaaagcgaugcgcaaaauacaccccuacaucaaagagaacaaauucagcaccgcuugcgaacuagccggauaccgccacucaaaacacucccucacuaaggaggagaacgacaaucgcguacucaaggacagccuagaaguacuaaagaaaaacucacuuagacaaccaguuguugagaaaauucuuaaccagaugaucaaccucgucaacgcccuacugaagaaauauagaacagaaaacccaaacuucaaauucgaugaaauccgaauagaacucgcccgagagcuaaagaaaaacgcagaggaaagagcuaacaugacagucaauauuaacaaagcuaaaacggaacacgaaaagauaaucaaaauccugaaaaacgaguucggccuacccaacccgacgcgcaacgauauuauucgguaccgucuauacgaggaacugaaagcaaauggauauaaggaccucuauacgaacgaauacauagaaaaacaagaucuauucaccaaaaauauagacauagaacauauuaucccuaagagccgcgucuucgacgacaguuuuucgaacaagacccucagcuucagaaagaccaaucuagacaaaggcgaaagaacggcauuugacuacauagagucaaaguucggcgccgacaagcuagaagaauacgucgccagaguagaagaucuauacaaaaacaacaucaucucuaaagccaaauaucaaaaacugcucaaaaaggaaagcgaaauaggagauggauucguugaacgagaccuaagggagacacaauacaucgccaaaaaggccaaagaaauauuacuccagauaacacccaacguccucuccaccagcggagggaucacggaccgccugagagaagacugggauuugaucaacgucaugaaagaauugaaccucccgaaauaccgggcacuggggcucacacaaauggaagaccgaaaauacggucaacaagucgagguaaucauagauuggacaaaaagaaacgaccacaggcaccacgcgauggacgcccuaacggucgccuucaccaaacacaaccacauacaauaccuaaauuaccucaacgcacgaaagaacgaaaaacaccgagaacacagcaacauaaugggaauccagcagcuagagaccauaaaagucaccgacaaaaacggcaacgaaaagcgagucuucaaagcccccaugccgaacuuccgucaggugacuaaggccuuccuggagaacguucuaauuucgcacaaggcuaagaacaaaguugucaccaaaaacaaaaacaaagucgccggcaguaacaaaguccaggaaguccucaccccacgaggacagcuucacaaggaaaccguguacgguaaguaccaguacuacguacaaaaggaggagaaaauaggaggaaaauuugaccuggaaaccaucaaaaaggucgcaaacccucuauaucaaagccuccugaagaaacggcuagaagaaaaugggggagacccgaagaaagccuucaccggcaaaaacagccuagccaaaaacccuaucuaccuggaugacgcacagacagaacagcuccccgaaaagguaaaacucguauggcuagaaaacuccuucuccauacggaaagacaucaccccagaaaacuucaaggacgagaaacuaaucgacaaaauacuagacgagggcguaaagcgaauacuaaaagagcgacuccagagcuuuggcaacgacgcaaagaaagccuucucagaccuugacaagaacccuauauggcucaacaaggagaaaggaaucgcgauuaaacggguagccaucucaggcgucgccaaugcagaaccacugcacaccaaaaaggaccaccuggggaaagaaauacucgacaaggaagggaaguccauacccguggacuuuaucagcacaggaaacaaccaccacgucgccgucuaccgagacgagaaaggcaaccugcaagaaaaaguagugucggucuucgaagcagucguucgagccaaccaaggucuccccauaauagacaaaaccuacaaccaacaccuggggugggaguuuuuauucacaaugaaacaaaaugaaauguucguauucucaaacgaaagcacagguuucaaccccaaugacauagaccuccuugacccaaagaauaaaaagauaauauccccaaaccuguuccggguacaaaaauuuagcaaacuccaguacgguaauagcuucguccgagaguucguuuuccgccaccaccucgaaaccacagucgaagauaggaaggaacuccaggguauaaccuacaaacaaaugaaaaacucggcauucuucaaugacauaauaaaaguacggauaaaccauuugggagggaucgucucggugggcgaauacuga

SEQ ID NO: 6826 - RNA, 4293 nt, Artificial Sequence
  Cas9 variant
augaaggacauacuggggcuagaccuaggcaccaauagcaucgguugggccgugguaaaggaagcacaaaacgacaacgagaccucagaaauaguagaccuagguguacgggucaauccccuaacaacagacgagaaaaccaacuucgaaaaaggaaaacccaucucaacuaacgcggaccguacccugaaaagaucagcacgccgaaaucuacagagguacaaacuccgacgaaaagaacucauagaacuccugaaggaacaccaacuuauauccaccgauacuauccucacagaaaacgguaaaggcacaucauuccagacccuugaacugcgagcaaagagcgcaaaagagaaaauuucccuagaagaauuggcccguguauuccuaacgauaaacaagaaacgcggguauaaauccagcagaaaagcaaagaacgaggacgagggccaacuaauugauggaauggagaucgcaaaacgccuguacgaagaaaaccuaacgacgggccaauuaucauuacagcuacuuaaggaaggcaagaagagucuaccugacuacuaccgguccgacuugcaauuugaacuagacaagguguggaacuuccagaaacaauuccacagccacauacucacggacgaguucuacgcucagcuaaaaggcaaagggcaacgcgcgaccucagcccucuuucucgcgaaauaccaaaucuacacagccgaaaauaaaggguccagagaagacaaaaaguugcaagcauaccaauggcggguagacgcacucagcaaagaacuaacccgggaacagcuagccuuugucauaacggagaucaacaacaaccucaacaacuccucaggguaccuaggcgccaucagugaccgcagcaaagaacuguauuucaauaacgagacagugggcgaauaccuauggaagcaaauagccgccaacccccacacaucccuuaaaaaucaagucuucuaucgccaagacuaccucgacgaauuugagcaaaucuggaacacacaagcccaauucuacccccaaaucuuaaccgacgagcuuaaaaaggaacuccgggacgucgugaucuucuaccaaagaaagcuaaagucacagaaaagccucgugagcuuuugugaguucgagaacaaggagaucgaaauuaagaaagaagacggcacaagcaccaagaagguaaucggccucaaaguugccccgaaaagcucaccgcuauuccaagaauuuaaaauuuggcaaaaccucaauaacgugcuaauucgaaagaaaggaucgaaaaccaaaaaggcggcgaaaaaccaacaagcuguccucuucgaagaggagaaaaccauaagugaacucgaccuagaagccaaacaagcacuauuuaacgaacucaacuuaaaaggcaacuuaaaagcagauuacugccucgaaauucugggcuauagccccaaagaaugggaaaugaacuauucgguccuagaaggcaacagaaccaacaaagcccuguacgaggcauaccuaaagauuacugaccuugaaggguacgacgccaaaaaccaccuaaaggucaagcucaacaaagacgaaguugaacuugacgaccugaaggugccggccuccgaaauaaaggacaugguacaagcaaucuucaaggaagcuggcaucaauacagacauccuucacuucaacgcggaacucgacggcaaagacuucgaaaaccaggcgagcuaccagcuauggcaccuacuauacagcuaugaaggggacgacucaaaaaguggaaacgaacuccuauacaagcuccuggagacgaaauucggcuucaagaaagaauacgcacaaauauuagcaaacgugagccugagcgacgacuacgggucgcucagcaccaaagccaugcgaaaaauccacccuuacauaaaggaaaacaaauuuucgacagccugcgaacuggcaggcuaccggcacagcaaacacagccuuaccaaggaagaaaacgauaacagagugcucaaagacucccucgagguccucaagaaaaacagccugcgccaaccggucgucgaaaagauccugaaccaaaugauaaaccuggugaacgcccuacucaagaaauaccgcacagaaaaucccaacuucaaauucgacgaaaucaggaucgaacucgccagagaacuaaagaaaaacgcggaagaaagagccaauaugacagccaauaucaacaaagcaaaaacugaacacgaaaagaucaucaaaauccucaaaaacgaguucggccuccccaacccaacccgcaacgacaucauacguuaccggcucuacgaagaacugaaagcgaacggauacaaagacuuguacaccaacaucaaaaucccacaggaaaaacucuucaccaaagagaucgacaucgaacacauaaucccaaagagcagaguauucgacgacucguucagcaacaagacacucaguuuccgcaaaacgaaccuagacaaaggagaacgaacggccuucgacuacauggaaagcaaguucggcgccgacaaacuggaagaguaugucgcccgcgucgaagaucuauacaaaaacaacauuaucucgaaagcgaaauaccagaagcuccuaaagaaagaguccgagauaggggacggcuucgucgagcgagacuuacgagaaacgcaauacaucgccaagaaagcgaaagaaaucuugcugcagaucacaccgaacguacuaucuacuucgggcggcauaaccgaccgccuccgagaagacugggaccuaaucaauguaaugaaagagcuaaaccuccccaaauaccgagcacuaggccuaacagaaauggaagaucgaaaauacggccagcaaguugaaguaaucaucgauuggacgaagagaaacgaccaccgccaccacgccauggaugcccugaccguggcguucacaaagcacaaccacauacaauaccugaacuaccuaaacgcgagaaagaacgaaaaacacaaagaacacagcaacauaaugggcauccaacaacucgaaacuauaaaagucaccgacaagaauggcaacgaaaagcgggucuucaaagccccaaugccaaacuuucggcaggucaccaaagcauuccuggagaacauacugaucagccacaaagcaaagaacaaagucgucaccaaaaacaaaaacaaaguagccgguucaaacaaaguacaagaaguacuuacacccagaggccaacuccacaaagaaaccguauacgggaaguaucaauauuacgugcaaaaagaggagaaaaucgggggaaaauucgaccucgaaacgaucaagaaaguagcaaacccgcuuuaccaaucgcugcuaaagaaaagacuagaagaaaacgggggagacccaaagaaagcguuuacaggcaaauauucccuggccaaaaacccgaucuaccuggacgacgcucaaacggagcaacuacccgaaaaagucaaacuugucugguuggaaaauagcuucucaauccgaaaagacauuaccccagaaaacuucaaagacgagaaacucaucgacaaaauacuugacgaaggagucaaacgcauucugaaagaacgacuacagucuuucggcaacgacgcgaagaaagcguucagcgauuuggacaaaaacccaaucuggcucaacaaagaaaaagguauuacuauaaaacggguaacuaucagcggaguagcaaacgcagaacccuugcacacgaagaaagaccaccucggaaaagaaauccuggacaaagaaggaaaaccgauacccguagauuuuaucagcaccggaucgaaccaccacguagccgucuauagagacgagaaaggcaaccuccaggaaaaggucguaucaguguucgaggcggucguccgagcaaaccagggccuacccaucauagacaagacauacaaccaacaccugggcugggaguuccucuucaccaugaagcaaaacgaaauguucguauuuccaaacgaaucgaccggguucaacccaaacgacaucgaccuacuagauccgaaaaauaaacggauaaucucccccaaccucuuccgcguacagacgauaagcgugguaaaauauggaaacgccaucgucagagacuucaaguucagacaucaucuggagacgacaguggaagacaagaaagaacuacaaggcaaaaccuaccagcagauaaaaagucuaucgccgcuuaacgacaucauaaaaguccggaucaaccaccuuggugauaucguguccgugggggaguauuga

SEQ ID NO: 6827 - RNA, 4293 nt, Artificial Sequence
  Cas9 variant
augaaacacauacucggucuggauuuaggcaccaacaguauaggaugggcauacgucaaagaagccgaaaacgacacggagaccagcgagauuguggaccuagggguccgaguaaacccgcuaacaaccgaugaaaagacaaacuucgaaaagggaaaacccauaagcaccaacgccgaccgcacacucaagaggagugcccgccguaaccuccagagauauaaacuccgccgcaaggaacuaaucgagcuccucaaagagcaccaacuuauaagugaaaacacgauuuuaaccgaaaacggcaaaggcacaaccuuucaaacacucgaacuacgggccaagucagcaaaagagaagauaagccucggggagcuagcacgcguguuccugacgauaaacaagaaacgcggcuacaaaagcucccgaaaagccaaaaacgaagacgaaggacagcucaucgacggcauggagaucgcaaaacgacuauacgaggagaaccucacaacuggccaauuaagccuucaacuccuaaaagagggcaaaaagucauugccagacuacuacagaagugaucuccaauucgaacuagacaaagucuggaacuuccaaaaacaauuccauagcgauauacucaccgacgaguucuaugcccagcucaaaggaaaagggcaaagggccacaagcgcccucuucuuagcaaaguaccaaaucuacacagccgagaacaaaggcucacgugaggacaaaaagcugcaggccuaccaauggcggguagacgcccucucgaaagagcucacaagagaacaacucgccuucguuauaacggaaauaaacaacaacuuaaacaacucgagcggcuaccucggcgccaucucggaccguucgaaagaacuauacuucaacaaugagaccgucggcgaauaucuauggaagcaaauugccgccaacccacacaccucccucaagaaccaggucuucuauaggcaagacuaccuggacgaguucgaacaaaucuggaacacccaagcccaauucuacccccaaauccucacagacgaacugaagaaggaacuacgagaugugguaaucuucuaccaaaggaagcucaagagccaaaagucccuaguuuccuucugcgaguucgaaaacaaggagauagaaaucaagaaagaagaugguacgagcaccaagaaggucaucggacucaaagucgccccuaagucgagcccgcuguuucaagaguucaaaauauggcaaaaccucaacaacguccuaauacguaaaaagggcagcaagaccaaaaaggccgccaagaaccaacaggccguccuauucgaagaagaaaagacaauauccgaacuagaccuggaagcaaagcaagcccuauucaacgaguugaaccucaaaggcaaccuaaaagccgauuacugccuggagauccuaggauacagccccaaagaaugggaaaugaacuacuccguacucgaagguaacaggaccaauaaggcacuauacgaagccuaccucaaaauuacagaccuugagggauacgacgcgaaaaaccaccucaaaguaaaacuuaacaaggacgaaguagagcuagacgaccucaaagugcccgcauccgaaaucaaagaaaugguacaagccauauucaaggaagcaggaauaaauacggauauacuccacuuuaacgccgagcucgacggaaaagacuucgaaaaucaagcuagcuaccaacucuggcaccuucuauacuccuacgaaggcgacgacagcaagagcgguaacgaacuccucuauaagcuacucgaaaccaaauucgguuuuaaaaaggaguacgcccagauacuggccaacgugagccucuccgacgacuacggaaaccucuccacuaaagccaugagaaaaauauacccauacaucaaggaaaacaaauucagcacagccugcgaacuggcuggguaccgucacagcaagcacagccuuaccaaagaagagaacgauaauaggguccuaaaagacagccuagagguacugaagaaaaacucucuacggcaacccgucgucgaaaagauacuaaaccaaaugauaaaccuagucaacgcccuacuaaagaaguaucgcaccgagaacccuaacuucaaguucgacgagauacgcaucgaacuagcacgggagcuaaagaaaaacgcagaggaacgcgcgaauaugaccgcuaauaucaacaaagccaagaccgagcacgagaaaaucaucaaaauccugaaaaacgaguucggacugcccaacccgacccgcaaugacaucauacgauaccgccucuacgaagaacucaaggccaacgguuacaaagaccuauacacaaacaucaaaaucccccaagaaaaacuauucaccaaagagaucgacauagaacacaucauccccaagagccgagucuucgacgacucguucuccaauaagacccucagcuucaggaaaacgaaccuagacaagggggaacguaccgccuucgauuacauggagagcaaauucggagccgacaagcuagaggaauacgucgcccgaguagaggauuuauacaagaacaacauaauaucgaaggccaaauaccaaaagcuccugaagaaagagagugaaauaggcgacggcuucguagagcgagaccugagagaaacacaguacaucgcaaagaaagcaaaagaaauucuacugcaaauaacgcgcaacguacugucgacaagcggaggcauaacagacaggcuccgcgaagacugggaccuggucaacgucaugaaagagcucaaccuaccgaaauaucgugcccucgggcucacugaaauggaagacagaaaauacggacaacaaguggaagucaucauagacuggaccaaacguaaugaccauagacaccacgcuauggacgcacucaccguggcauucacuaagcacaaucacauacaguaccuaaacuaccucaacgcgcgaaagaacgaaaaacacagagaacacaguaacauuaugggaauccagcaacucgagacgaucaaaguaaccgauaaaaacgggaacgaaaaacgcguauucaaagcccccaugccgaacuuccgacaggucacaaaagcauuccuagaaaacgugcucaucagccacaaagcgaagaacaaggugguuaccaaaaacaagaacaagguggcuggcuccaacaaaguccaagaggugcucaccccucggggacagcugcacaaggaaacggucuacggcaaauaccaauacuacguccaaaaggaggagaaaauagggggcaaauucgaccucgaaaccaucaaaaaggucgcaaacccccucuaccaaagccuauugaagaaaaggcuugaggaaaacggaggcgaccccaaaaaggcauucaccggcaaaaacucacucgccaaaaacccaauauaccucgacgacgcccagaccgagcaauuaccagaaaaggucaaacucguauggcuggagaacagcuuuagcauacggaaagacaucacaccagaaaacuucaaggacgaaaaacugaucgacaaaauucuggacgaaggaguaaaacgcaucuuaaaagaaagacuucaguccuucgggaacgaugccaagaaagcauucagcgaccucgacaaaaaccccaucuggcugaacaaggaaaagggcaucacuaucaaacgcgugacgauaagcggugucgcgaacgccgaaccccuacacaccaaaaaggaccaucuaggcaaggagauacuagacaaggagggaaaacccaucccgguagacuucauaagcacaggaagcaaccaccaugucgccgucuaccgugacgaaaaggggaaccuccaagagaaggucguauccguuuucgaagccgucguccgcgccaaucaagggcuaccaaucaucgacaaaacauacaacgaacaucuuggaugggaguuccucuucaccaugaaacagaacgaaauguucgucuuccccaacgaauccaccggauucaaccccaacgacaucgaucuacuagauccgaaaaacaaacgcauaaucuccccaaaccuguucagaguacaaaccaucucagucguaaaguacgggaacgccaucguacgagacuucaaguuccgccaccaccuagaaacaacagucgaagacaagaaagaacugcaggggaaaacguaccaacaaaucaaaucucuaagcccccuaaacgacaucaucaaagucaggauaaaucaccuaggagauauaguuucagugggggaauacuga

SEQ ID NO: 6828 - RNA, 4293 nt, Artificial Sequence
  Cas9 variant
auggcgcaaaaguauauucuaggcuuggaccuagggaccaauuccauaggaugggccgucgucaaggaagcagaaaaugacaacgaacagucagaaauagucgacgucggaguucgagucaacccacugacaacagacgagaaaacaaacuuugaaaaggggaaacccaucucaacgaacgcagaccgaacacugaaacggggagcucgccggaacuuacaacgguacaaacugcgacgaaaggaacuaaucaaaaucuuaaaagagcaccagcuaaucagcgacgauaccauacucgcugaaaacggaaaaggcacgacauaccaaacccugaagcugagagcaaaaaguucaaaagaaaagauaagccucgaggaauuagcgcgggucuuucugacgauaaacaagaaacgcggcuacaaauccaguaggaaaacgaaaaacgaggacgagggacaacuaaucgacggcauggaaauagcaaaaagacucuacgaagaaaacuuaacgacaggccagcuaagccuccaacugcugaaagaaggaaagaaaagccugcccgacuauuaccggagcgaccucgagcucgagcucgacaagguauggaacuuucagaaacaguuucauagcgacauccucacagacgaauuuuacacgcaacugaaaggcaaggggcaaagagccaccagugcacuauuuuuagagaaguaccaaaucuacacagucgaaaauaaaggcaaccgggaagagaaaaaccuccaggcauaccaauggcgcgucgacgcgcucucaaaagagcucacaagagaggaacuggccuucguaaucacagagauaaacaacaaucucaacaacucgagcggcuaucuuggcgccauaagcgaccgcucaaaggaacucuauuucaacaacgagaccguaggcgaguaccucuggaagcaaauugccgcuaacccccacaccucucugaagaaccagguauucuaccggcaggacuaucuagacgaguucgaacgcauauggaacacacaagcacaauucuacccacaaauacucacggaaagccucaagaaagagcugagggacgugguaaucuucuaccagcgcaagcuaaaaucacaaaagagccuggugucauuuugcgaguucgaaaacaaggaaaucgaaauaaagaacgaagacggaacaacaacaaagaaaguaaucgggcugaaaguugcacccaaauccuccccgcuauuccaggaguucaagaucuggcagaaccuuaacaacgucuuaauccgcaagaaaggcagcaaaacugaaaaagucgcaaagaaccaacaggucguccuguucgaagaagagaaaaccaucucugaacuggaccuggaagccaagcaagcccuuuucaacgagcucaacuuaaaagguaaucuaaaagccgacuacugccucgagauucuagguuauagcagcaaagaaugggagaugaacuacucgguccucgaggguaacaggacaaacaaagcccuguacgaagcguaccuaaaaaucaccgaucucgaggguuacgacgccaagaacuacuugaaaguaaaaucgaacaaggacgaagucgaacuagacgaucugaaagugccggcuucagagauaaaagaaaugguccaagcgaucuucaaagaagcgggcauaaacacagacauccuccacuuugacgcagagcucgacggaaaagauuuugaaaaccaggggucuuacaagcucuggcaucugcuauacucauacgaaggcgacgacagcaagucgggaaacgagcuacucuauaaacuacuagaaacgaaguucggccucaagaaagaauacgcccagauacuagcgaacauuucccuaagcgacgacuacgggaaccuguccacaaaagcgaugcggaagauccacccguacaucaaggaaaacaaguucagcacagccugcgaacucgcaggguaucgccacuccaaacacagccuaacaaaagaagagaacgagaagcgcguacucaaagacggccucgaagugcuaaagaaaaacagccugcgacagccagucgucgagaaaauacucaaucagaugauaaaccuagucaacgcccuacuaaagaaauaccgaaccgaaaaccccaacuucaaauucgacgagaucagaaucgaacuggcacgagaacuaaagaaaaacgccgaagaacgagccaacaugacugccaauaucaacaaagcgaaaacagagcacgagaaaauugacaaaauccuuaagucagaauuugggcucccuaaccccacgcgcaacgauauaauaagauaucgccuguacgaagaacucaaggccaacggguauaaggaccuauacaccaaccgauacaucaguagcgagaaacuauucagcaaagaaauugacauagaacacaucaucccaaagucccgcguauucgacgacuccuucagcaacaagacaauagucuacaggaccgauaaccuggacaaaggcgaacaaaccgccuacgacuacaucgaaagcaaguucggcgcggaaaaauuaaaagaauacaugacccgcguuaaagaccuauaccagaaaaagaucauauccaaagccaaguaccaaaaacuccuaaagaaagaaucggaaaucggcgauggguucgucgaaagggaccugcgggaaacccaguacauagccaagaaagcgaaagagauucuucuacaaaucacccacaacguccuguccaccucgggaggcaucaccgaccgacuaagaaaggacuggggccuugucaacguaaugaaagaacuaaaccuacccaaauaccgggcauuaggucuaacaaaaauggaagaccgaaaauacggccagcaaguggagguaauaaccgauuggacgaaacgaaacgaccuaagacaccacgccauggacgcacucaccgucgcauuuaccaaacauaaccacauacaauaccuaaacuaccucaacgcaaggaaaaacgaaaaacacaaagagcacaacaacaucauggccauccaacaacucgagaccaucaaagucaccgacgagaacgguaaugaaaaacgaaucuucaaagcgccuaugccgaacuuccgacaaguagcaaaaacauuccuagaaaacguauuaaucagccacaaggccaagaacaaagucgucaccaaaaauaagaacaaaauaucgggaagcaacaaaguccaggaaguccucacaccucggggccaacuacacaaagagaccguauacggcaaauaccaguacuacguccagaaagaagagaaaauuggcgcaaaauuugacucagaaacgauagaaaaagucgccaacccgcuauaccaaagccugcucaaaaagcgccuugaggaaaacggaggagacccaaagaaggcauucacaggaaagaacucccucgccaaaaacccaaucuacuuggacgacacacaaaccgaacaauugccagaaaaaguaaagcuagucuggcuugaaaacagcuuuuccauacgaaaagacauaaccccagagaacuuuaaggacgaaaagcucaucgacaaaauccucgacgaaggagugaaacggauacucaaggaaagacuacagagcuucggcaacgacgcgaagaaagccuucuccgacuuggagaaaaacccgaucuggcugaacaaagaaaaagggaucgcaaucaaaagggucaccaucucagggguggccaacgcugaaccacuacacaccaagaaagaccaccucggaaaagagauccuagacaaagaggggaaacccauccccguggacuucaucucgaccggcaauaaccaccauguggccguauacagagacgaaaaagggaacuuacaagagaagguccuguccgucuucgaagcgguuguaagggcaaaucaaggacucccaaucaucgagaaaacguacaaccaacaccuaggaugggaauuucucuucucaaugaaacaaaacgagauguucguauuucccaacgaaucaacgggauucaaccccaacgauaucgaucugcuggaccccaaaaacaagcguaucaucagcccaaaccuauucaagguacaaaaacucgcaacuaaaaacuacauguucacacaccacuuagaaacaaaauccaucgacggagacaugcugaaaaacaaaaaggaacucuccgggauucuauauaacuucauccaaacuccacaaaaacuguauggaaucaucaaaguccgcaucaaccaccuaggcgacaucgugucggucggcgaguacuga

SEQ ID NO: 6829 - RNA, 4296 nt, Artificial Sequence
  Cas9 variant
augaaacggauccuuggacucgaccucggcuccucaagcauaggcugggcccucguaaacgaggcagagucaaagaacgagcgaagcuccaucguaaaacugggcguacgcgucaauccccucacgguggacgaguccauaaauuucgaaaagggcaaguccaucacuaccaacgcagaccgaacauugaaacgcagcaugcggcggaacuuacaccgcuacaaacuucgccgugaagcucuaaucgaaguccugaaagaauguaaauucauaacugaagacacaauacuuagcgagaacggaaaccgcacaacauucgaaacauaucgacugaggguaaaagcccucaccgaagaaauaagucuugaggaauuugcuagaguccugaucaugaucaacaagaaaaggggcuacaaauccagccgcaaagccggcggugccgaagaggacacacugauagacggcauggacaucgcccgcaagcuguaugaugcgaaccucacaccgggcgaacuaugccuacaacuccucucagcgggcaagaaaguacugccggacuucuacagaagugaccuacaaaacgaacucgaccgcaucugggagaaacaaaaagaguacuacccugggauucucacugcagcccucaaggaggaacuccgaggcaagaaacgcgacgccguaugggcaaucugcgccaacgcguucguguggaaagagaccuacaccgaauggaacaacgaggagagcaaaaacgagcagauagagaaagaacacaaacucgaaggcaucuauagcaagcgcaagagagaugaagccaagaaagaaaaucuccaguggcgcgugucuggccucaaagaaaaacuaucccuggagcaacuggucaucauacuucaggaaaucaacacucaaaucaacaacucaagcggcuaccucggcacaauaucggaccgcuccaaagaauuguacuucaacaaacaaaccguagggcaguaucuaauggacauccucgacaacaacccaaacgccagcuuaagaaacaucgucuucuaccgacaggacuaccuagacgaguuuaacguccuaugggagaagcaagcagaguuccacaaagaacuaacaggagaacuaaagaaagaaauccgagacauaaucauauucuaucagcgccgccugaaaagccagaaaggguuaauauccuucugcgaguucgaauccaggcaaaucgaaguaaagauagacgguaaacgaaagauaagaacgguaggaaacagagugaucccccggagcagcccguuguuucaagaguucaaaaucuggcaaauccucaacaacaucgaagucaccgccguugguaacaagaacaaacaacgcaugcagaacggaagcaacgagccagacgacacagaacaacucgaauugaacggaagacgauaccuauaccaggaggaaaaagagcuccuggcaaaggaacuguucguccgagacaaaaugacgaaacucgacguccuacguuuacuguucgacaaccccgaagaacuugaccuaaacuucaaaacaauagacggcaacaaaaccggcuaccuuuucuuccaggcauacucaaaaaugauagagauguccggccacgaacccguagacuucaagaagccaaucgaaaagauugucgagcaagucaaauccgucuucguccuacuuaacuggaacacagacauccuaucauuugacucaaacaaggaauuagacaagcaaagcuacuacaaacuuuggcaccuauuguacagcuucgagggcgacaauacucccacgggaaacgggugcuuaguucagaagauaauggacagcuacggccuaggcaaggaguucgccaagauucuagcaaacaucacauuucaagaggauuacggaagucugagugcaaaagccauccacaaaauacuuccgcaccucaaagaggguaaccaguacgacgucgccugcgaauacgccggguaccgccacucuaaaaguaguuuaaccaaagaggagaucgcaaacaaggugcuuaaagauaagcuagaagugcugccacgaaacagccuacgcaacccggucguagagaaaauuuuaaaccaaaugguaaauguaauuaacgccauaauagaggcauauggcagacccgacgagauccgaguugaacuugcaagagaacucaagaaaaacgcuaaagagcgggaaaaacucacaaaaucaaucgcggaaaccacgaagacacacgaggcgcacaagaaacuacuccaagaagaguucggacucaaaaacgucggcaggagcgacauacuacgcuacaaacuauacaaagaauuagaaagccgcggcuacaaaacccucuacagcaacacauauauccccagagaaaagcuguucuccaaggaguucgauaucgaacacaucaucccccaagcccgccucuucgacgacagcuucagcaacaaaacacuagaagcacgaaacguaaacauagaaaaggguaaccgaacggcguacgacuucguaaaggaaaaguucggagagucgggaacugacaacucacuagauugcuaccugaacaacauugaaguucuguucgugucaggaaaaaucagcaagaccaaauacaccaagcugaaaaugaccgaacaggacauuccgggaggguucaucgaacgagaccuaagaaacacccaguacaucgcaaagaaagcgcuuagcaugcucaaugagauaucccguugcguagucgcgacgagcgggagcaucaccgacaaacuacgcgaggacuggcagcucgucgacguaaugaaagagcuaaauugggagaaguacaaggcccuggggcucguagaguacuuugaggacaaagauggaaaacagaucggacgcaucaaagauuggagcaagcgcaacgaccaccgccaccaugccauggacgcccucacaguagcauucaccaaggagguauucauacaauacuucaacaacaagaacgcuagucucaaccccaauacgaaugaguacgccaucaaaaacaaauacuuccaaaacggacgugccauagccccaaucccccugaacgaguuucgggcagaagccaagaaacaucuugagaacacacuuauaucaaucaaagcgaaaaacaaagucaucacuaacaacauaaacaaaaccaaaaagcgcgggggaguaaauacaaagaagcaacaaacaccccgcggccagcuucaccuagaaacaaucuacggaugcugccgacaauaccucaccaaggaagaaaaaguaaaugccuccuucgacgucuccaaaauagcgacagugagcuccagugucuaucgggacgcccuccuuaagcgacuacaggaacaccacaacgacccaaagaaagcauucgccggacgcaacagucucgacaagaaaccaguuugguuagacaaagaacaaaucagaaaagucccggaaaaagucaaaaccgucacauucgaaacuauauacacaauccgaaaagaaaucagcccggaccuuagagucgacaaaauaaucgauagcggaguacgcaaaaugcuuacgggcaggcuaaaagaauacggaaacgacgcgaagaaagccuuuagcaaccuugacgaaaaacccaucuggcuaaacaaagaaaaagggaucccgauaaaacgcgucaccaucuccggaaucagcaacgcgcaaucccuucacgucaaaaaggauaaggacgggaaaccagugcucgacggcaauggccguaacauccccgucgacuucguaaacacgggaaacaaccaccauguagccguguaccgcagaccaguaaucgacaaaaauggccagauggucaucgacgaaaacggcaaccucaaauacgaacucgaagaagucguugucaccuucuucgacgcaguaacaagaguaaaccucggacaaccgauaauagacaaagauuacaaggccuccgaaggcuggcaguuccucuucagcaugaaacagaacgaguacuuugucuuccccaacaagaaaacaggauucaaccccaaagaaaucgaccuacucgacgcagacaacuacggccugauaucgccgaacuuguuccgagugcagaaauucacgcauaagaacuacguauucaggcaccaccuagaaaccaccaucaaggacacgucaagcauacuacggggaaucacguggaucgacuuccggagcaguaagggccuggacucaauagugaaaguacggguaaaccacauaggacaaaucgucagcguaggagaguauuga

SEQ ID NO: 6830 - RNA, 4299 nt, Artificial Sequence
  Cas9 variant
augaagaaaauacuaggacuagaucuagguagcaacagcauaggaugggcccuagucaacgaggccgaaaacagagacgaagcaucaucgaucauaaagcuaggggugcggguaaacccacucacggucgacgagaugcagaacuuugaaaagggaaagagcaucacaaccaacgcggacagaacacucaaaagguccaugagacgcaaccugcagcgcuacaaacuacgacgggacgcgcucaucaaacugcugaaaaaggugggguucauagcagacgguaccauacuaagcgaacaagggaaccgcucgacuuucgaaacauaucgacuacgggcaaaggccccagacgaggaaauaagccugcaagaacuagcaagaguacuccucaugaucaacaagaaacguggcuacaaaagcagcagaaaaaucaaggaaaaagaggcaggcacccuaaucgacggcaugaagguggcgaagaaacucuacgaugaggaccuaacaccgggacagcucugccugcagcuccuggagucgggaaagaaaucacugccagauuuuuacucgagcgaccuucaagaagaguucgaccgaauauggaauuuccagaaacaauucaauccaaaagcauuuugcgacacagccaaagaggaaauaaaaggcaagaacaaaucgcagacuugggccauucuagccaaguacuucauuuggacagacgagaugguagucuggaacgaaaaggagucaaaaaccgagagggucgaaaaagaaugcaagcuagugggccuaaaacgcacggugaagaaagaagaacagcgaaaagaaaacuaccgauggcggguccaggcacucaccgaacaacucgaccuagggaaaguagccgucguucugcaagaaaucaauggacagaucagcacgucaaguggguaccuaggagcgauaagcgauagguccaaaguucuauacuuuaaccggcaaaccgugggacaauaccaaauggcugagcucgagaaaaaucccaacacgucccucaggaacaugguauucuaccgacaagacuaccucgacgaguucgacaaaauaugggaaaaacaagcggaguuccacaaagaacugacaguagagcuaaagaaggagauccgugacaucaucauuuucuaucaacggcgccucaagucgcaaaaaggccuaauaggcuucugcgaguucgaaaaccgagaaauaaugguugaaaagaacggcaagaugcaagccaaagucgucggcugcaaaguuauucccaggagucacccacuguuccaagaauuuaagaucuggcaaacccugaacaacgucgagguauuugccggugagaagaaaugcaaacgcaagcgaacggacgcauuccccggacucuucgacgggaccgaggacacccuaaugguagaaggcuggcgcuaccuauaccaagaagaaaaagaaauccuugcgaaagaacuguccgucaagaaaucccucaagaaagaauacauacuaaaacugcuguucgacaacccccaagacuuggauaugaacuucgagcaaaucgaaggcaacgacaccggaaacguccuguucagcgcauauuccaaaaugaucgaaaaguacggauaugagccacuugauuucggaaaguccacagacgaaaucauagagcgccuacaagucauauucacggaucucggauggaacaccgaccuccuguucguagaccuaaacaaggaaggaaaagaccucgagaaacagcccuacuucaaacucuggcaccucuuauacagcuucgagggagacaauaccccaacaggcaauggcaagcuggucgagaaacucauggagcucugccacgucgggaaagaaugcgccuuggaacucgucaacaucagcuuucagaacgacuacggcucgcuaagcgccaaagcaauaaagaaaauccuacccuaucuaaaagaagggaaucgauacgacgucgcaugcggauacgcaggauacaggcacucaaaauccuccuugacgaaagaagaaaucgaaaauaaaguccuaaaagauaagcuagacauauuacccaaaaauagccuacggaacccaguaauagagaaaauccuaaaucagauggucaacguaaucaaugcgaucaucgacacauacggaaaacccgacgaaaucagaguggaauuggcacgcgaacucaagaaaucagccaaagagcgcgacgaacugacaaaagcaauagcuaaaagcacacgagagcacgaggagauaagaaagguccuacaggaagaguucggcaugaucaaugucagucgcaacgacaucaucagguauaaauuauacgaagaacucaaagacaauggguacaaaacgcucuacagcaaccaguacauaccgaaggagaaggucuucucaaaagagaucgacauagaacauauaaucccccaagccagacucuucgacgacaguuuaucaaacaaaacccucgaauacaaagccauaaacauugaaaaaggcaauaaaacagccuacgacuucgucaaggaaaaguacggcgaaaaaggucugcagcaauaccuaaaccgcugcgaaagccuguucaaaggacaccgcaccaaacuaagaaaacugaaaaugggacaagaaaauauaccagagggauucauagaucgagaucuccgaaacacgcaauacauugcaaagaaagcacucgcaaugcucaacgagaucugcagacgaguagucgcgacgaccggcucaauaacggaccgccugcgcgaagacuggcagcugguagacguccugaaagagcuaaaucuacccaaauacgaaacacucggccucgucgaaguauaugaagacaaagacggcaggaaaauuaaaaggaucaaagauuggacaaaacgcaacgaccacaggcaccacgcuauggacgcccuaaccgucgcauucacaaaggacgucuucauacaguacuucaacaacaaaaacgcggccuggcaagcugauugcaaagaacauucagauaucauaggaaucaaaacgagguacuuugaaaacggacgcgcacuaccacccaugccacuggugcguuucagagcggaagccaaaagccaccuggagacacugcucgugagcauaaaggcaaagaauaaaguagucacaaauaacguaaauuguacuaaacggaaagggggcgagaacaagaaacugcaacagacgccccgcggacaacuccaccuggagaccauuuacgggagccaccggcaguacgugaugaaagaggaaaaggucaacgccucguucgauuccuccaaaauagccacagucugcaaacaggccuaccgcaacgcgcucuuagaacgccuagcagccuucggcaacgacccgaaaaaggcguucaccgggaaaaacucgcuagagaaaaacccggucuaccucgaucgggaacagaccgcucgaguaccagaaagagucagaacaguagaacucgaaacuguguacaccauaagaaagccagucgacccgaaccuuuccguagacaaagucgucgacgccaaaguacgaagcauccuggaacaacgccugagagaauaugacggagaagcgaaaagagcguucgucaaucuggacgaaaacccaaucuggcuaaacgaagagaagggcaucgccauaaaacgcguaacaauccgcggcaucaacaaaguccagagcuuacacgggaaaaaggacaagaauggcaaccuaauccuggacgaaacaggaaagaaaauucccguagacuucgucaacacgggcaacaaccaccacgucgccauauacagaaaaccaguccuggacaaaaccggccaagagaugcuagacaacgaaggcaacccgguauacgaacucgacgaggucguggugagcuuuuucgaggcuguaaccaggguaaaccuaggccugcccgugauagacaaaaacuacaacaaaagugaaggcuggcaauucauguucacgaugaaacagaacgaauacuucguguuccccaaugagaaaacaggguucgacccuaaggaagucgacuuacucaaccccgaaaacuacgccgucaucuccccaaaccuuuuccgcguccagaaaaucacagaaaaggacuacauguuccgacaccaccuagaaaccaaaguaguggacgacaaauucuuaaaagaaauaaccuggaaacgcauacuaacaccgaacaagcucgagggcauaguaaaagugcgugucaaccacaucggacagaucguauccgucggggaauacuga

SEQ ID NO: 6831 - RNA, 4299 nt, Artificial Sequence
  Cas9 variant
augaagaaaauauuaggccuagaucuaggcagcaacagcauaggcugggcgcuaguaaaugaagcagaaaacucugacgaagucagcuccauuaucaaguuaggugucagggucaacccccuaaccgucgacgaaaugcagaacuuugagaaaggaaaaagcaucacaacaaaugcugacaggacucucaaaagaucgaugcgcagaaaccugcaacgauacaaacuaagaagagacgcacucauaaagcuccuaaagaaagugggguuuaucacggacggcaccauacucagugaacaaggaaacagaacaacguucgaaaccuaccgacuacgagccaaggcgccagacgaagagauaucauugcaagagcuggcccggguccuccuaaugauaaacaagaaacggggcuacaaauccucaaggaaaaucaaagagaaagaggcgggaacccugauugacgggauggagguggccaagaagcucuacgacgaggaccuaacaccagggcaacucugccuacagcuccuagagagcgggaaaaagucgcugccggacuucuacucaucggaccuacaagaagaauuugaccgcaucuggaacuuccagaaacaauucaauccuaaagccuucugugacacggccaaggaggagauaaaaggaaagaacaagucccagacaugggcaauauuagccaaauacuucaucuggaccgacgaaauggucgucuggaacgaaaaagagucaaaaacagaaagaguagagaaagagugcaaguuaguaggacucaaacgcaccguaaagaaagaagaacagcgcaaagagaacuacugcuggagaguacaggcccucacggaacagcuggaccuagaaaaaguggcagucguccuucaggaaauaaacgggcagaucagcacaagcucaggcuaccuaggggcgauaagugaccguucgaaaguccucuacuuuaaccggcaaaccguugggcaguaccagauggcagagcuugaaaagaaccccaacacaagccuacgcaacaugguuuucuaccggcaagacuaccucgaugaguuugacaagauaugggagaaacaggccgaauuucacaaagagcuaacaguggagcuaaagaaagaaauaagggacauaaucaucuucuaccagcgccgucuuaaaucgcaaaaaggacugaucggcuuuugcgaguucgaaaaccgugagaucaugguagagaagaacgggaaaaugcaagcuaagguggugggcugcaaaguaaucccccgcagucauccccuguuccaggaguuuaagauauggcaaacccucaacaacguggaagucuucgcgggagaaaagaaaugcaaacgcaaacgcacugacgcuuuuccuggccuguucgacgggacagaagacacgcugaugguagaaggcuggcgcuaccuguaccaagaagagaaggagauacucgccaaagaacuaagcgucaagaaaagccucaaaaaggaauacauccuaaaacuacuguucgauaauccccaagacuuggauaugaacuucgaacagauugaaggcaacgacacaggaaacguacucuucagcgccuacagcaaaaugauagaaaaguauggauacgaaccccucgacuucggcaaaccaacggacaagaucauagaacaacuacaagugauauucgccgaccuaggauggaacaccgaucuccucuucguggaccuaaacaaagagggaaaagaccucgaaaaacaaccauauuucaagcucuggcacuugcuauacagcuucgaaggagauaacacaccaaccggcaacggaaaacucguagagaaacuaauggaacucugccacguagggaaagagugcgcacucgaacucguaaacaucuccuuccagaacgacuauggcucccugagugcaaaagcaaucaaaaagauccucccguaccugaaagaggggaaccgcuaugacguagcaugcggcuacgccggguaccgacacagcaaaagcucauuaaccaaagaggagauagagaacaaagugcucaaagauaagcuagacauccuacccaaaaacagccuccgaaacccagucgucgagaagauacugaaccaaaugguaaacguaauaaacgcgauaauagacacguacgggaaaccggacgagauacgggucgaacuagcgagggaacuaaagaaaucagcaaaggaacgggaggaacuuaccaaagccaucgcaaagagcacaagggaacaugaagagauccgaaaaguccuccaagaagaguucgguaugaucaacgugucaaggaacgacauaauacgauacaaacuguacgaggaacucaaagacaauggauauaaaaccuuauacagcaaccaauacauuccaaaggagaaaguauucagcaaggagauagauauagaacacauaaucccgcaagcgagacuuuucgacgacagccuauccaacaaaacgcuggaauauaaagcaaucaacaucgagaaaggcaauaaaacagcuuacgacuucguaaaagaaaaguacggggagaagggccuccaacaguaucuaaaucggugugaaucacuguucaagggacaacggaccaaacuacgcaagcugaaaaugggacaagaaaacauaccugaaggguucaucgaucgagaccuccgcaacacacaauacauagcaaagaaagcacucgcaaugcucaacgagauaugccgccgggugguagccacuacaggcagcauaaccgacaggcucagagaagacuggcagcucgucgacgugcuuaaagaacuaaaccucccgaaauacgagacucuaggccuagucgagguguaugaagacaaagacggaaggaaaauaaaacggauuaaagacuggacgaagcgaaacgaccaccgccaccacgcaauggaugcccugacugucgcauucaccaaggacguuuucauacaguacuucaacaauaaaaaugcagcguggcaagcggacugcaaagagcacucagacauuauuggcaucaaaacaagauacuucgaaaacggacggucacuacccccgaugccccuaguccgcuucagagccgaagcaaaaucccaccucgagacucuacucgucucgauaaaggccaaaaacaaaguaguuacuaacaacguaaacugcacaaagagaaaggguggcgagaacaagaaauuacaacagucacccagaggacaacuccaccuggaaacaaucuauggaucacaccggcaauacgucacaaaagaagagaaaguaaaugccuccuucgacagcuccaaaaucgccaccgugugcaaacaagccuaccgaaacgcccuccucgaacgguuagccgcguucggaaacgacccgaaaaaggcauucacaggcaaaaacuccuuggagaaaaacccaguguaccuaaacagggaacaaacagcccguguccccgaacgcgugcgcaccgucgaacuagaaaccgucuacaccauccggaagccgguagaccccaaccuauccguagacaaaguugucgacgccaaaguuaggaguauacuggagcagcgccugcgcgaauacgauggcgaggcgaaaagggccuucgugaaccuagacgaaaacccaaucuggcuuaacgaagaaaaaggaauagcgaucaaacgggucaccauacgagggaucaacaaagugcagagcuugcacgguaaaaaggacaagaacggaaaccuaauccucgacgaaacagggaagaaaauacccguggacuucgugaacacaggaaacaaccaccacgucgcaauauaccgaaaaccaguccugaacaaaaccgggcaagaaauguuagacaacgagggcaauccaguauacgagcucgacgagguaguggugagcuuuuucgaagcugucacccgagugaaccuaggacuaccggucauagacaagaacuacaacaaauccgaaggauggcaauucauguuuaccaugaagcaaaacgaauacuuuguauucccgaaugagaaaacucgguucgauccaaaagaagucgaccuccucaacccagaaaacuacgcagucauuucacccaaccuguuccgcguccagaaaaucacagaaaaggacuacauguuccgacaccaccuagagacgaagguaguugacgacaaauuccugaaagagaucacauggaaacggauccugacacccaacaaacuagaaggaaucguaaaaguccgcguaaaccauaucgggcaaaucgucuccguaggagaauacuga

SEQ ID NO: 6832 - RNA, 4299 nt, Artificial Sequence
  Cas9 variant
augaagaacaucuuaggccuugaccucggcacaaccucuaucggauucgcccacauaguagaagaugaaaauaaagaaaagucggagauaaaggaacuagggguccggauagucagucugaccaccgacgaacagucggacuucgaaaaggggaaaucaaucaccacaaacgcgaacagaacucuaaaacauggagcgcgacugaaccuggaccgcuaccaacaaagacgcaaauaccucaucgaccuccuucacaaagcgaaccucauaacaccgucaucaauccuggcggagaacggcaaaaacaccacacauuccacguggcaacuccgcgcgaaagcugucaccgagcggauugaaaaggaggaguucgcccgaauccucuuggccauaaacaaaaagaggggauacaagaguucgcggaaagccaaaaccgaggacgaaggacaagcgauagacggaauggcaaucgcaaaacgucucuacgacgaaaaccuaacccccggccaacucagccuacagcuucuacaacaaaacaagaaacuucuaccggacuucuaccggucggacuuacagaaagaguucgaccucguauggaacuuccaaaaacaauucuaccccgacauccugaccgauauauucuacaaagaacuucaaggaaaaggaaaggaugcgaccagcaaggccuuuucgaaacgcuaccacuuugacacagcggaaaacaaaggcuccaaagagagcguaaggcuccaagccuaccaguggcgcgcugaggcugucaguaagcaacucagcaaagaagaggucgccuacgugcucaccgaaauaaacaacaaccugaacaacgcaagcggcuaccucggugcaaucucagaucgcagcaaagaacucuacuucaaccgacaaacagucggacaauaccucuacgcacaacuacaagaaaaccgacauaacucccucaagaacaaggucuucuaccgacaagacuaccuagacgaguucgagcgcauaugggaaacacaggcccuuuuccacaaggaacucaccgacgaacugaagaaacagauccgcgacgucgucauauuuuaccaacggaagccuaaaagccagaaaggccuaaucuccuucugcgaauuugaaagcaaagaaaucgagaucgagaaagauggcaaaaccauaacaaagaacauaggagcucgggucguccccaaauccucaccacuuuuccaggaguucaaaaucuggcaaauucuuaacaacguuauuugcaaaagaaaaggcauacggaaaaagaagauauccgccaaaacgacccaacucgaccuccuaaacgaaagcucccagaccaucuucagccuagacauggagugcaaacaacuccuguucgacgaacugaaccuuaaaggagacuugaaaagcgacaaaguccuaaaacuucuuggcuacucaccacaagagugggagauaaacuacaaccagcucgaaggaaauagaacucagaaagcccuuuacgaagcguaccucaaaaucgucgagauggaggcccacgauguaaaggauauccuccaaauaaaaagcaccaaagaugacuggucacucgacgaaagcccccuauccgcuagcgaaauacgagaaagcgucaaagcuaucuuccaagcguuagggauauguaccaaaauacuauacuucgacccccuauuaccgguaaaagacuuugaggagcaagacuccuaccaacuuuggcaucugcuguauagcuacgaaagcgaugacagcacauccgggaacgagacacucuaccggauccuggaaaagaaauaugccuucaaacgagaacacgcccgcaucuuggcaaacgucgcacuccaggacgacuauggcucacuguccacuaaagccauacgaaaaauuuauccaaacaucaaggagaaccaauacagcaccgccugcgaaauggccggcuacaagcacuccaagcuaucauugaccaccgaagaacuggaagcgcgagaacuaaagaacaucaucccccuccugaagaaaaacgcccuccgcaaccccguagucgagaaaauauuaaaccagaugaucaacguaguaaaugcccucaucgagaaaaacuccgaacgagacgccgaaggcaagauaacaaaguacuuccacuuugaugaaaucagaauagaacucgcccgggagcuaaagaaaaacgcccaaaaacgcuacgaaaugacacagaauaucaacaaggcaaaauccgaacaccaaaagauuucagaaauccuacagaaggaauuuggaaucaaaaacccaacaaaaucagauauaauucgcuaucgccucuauaaggagcuugaacacaacggauacaaggaacuuuacacaaacacauauaucgcccccgacguccuguucagcaaaaacauagacauagaacacaucguuccuaaggcccgcguauucgacgacuccuuuuccaauaaaacacuugcguuuaaggacuucaauauuaagaaaggcgaauccacagcauucgacuacauuacaucgcucaaaaacgaagaaaaacuaaaccaauaccuggcacgcguagagaacgccuacaagaccaagaacaucagccccgcaaaauacaaaaaccuacucaagaaagccuccgagauaggagauggcuucaucaaccgcgaccuaagggacacccaguacaucgccaagaaagcaaaagagauacucuuccaagucaccaaaaacguccucucuacauccgguagcaucaccgaccgccuacgagaggacuggagccucguggaugugaugaaagaauuaaauaugcccaaauaucaaucccuggggcuaacagaaguagaggaacgaaaagacggcaacaaagucaccguuauaaaagacuggaccaaacgcaacgaccaccggcaccacgccauggaugcccuaacaguugcuuucacgaaaccaagcuacauccaauaccugaaccaccuaaacgcgcggaaagacgaaaacaacaaaaacuacuccguaauccucgccauagagaagaaagaaaccaucaaagugccgacgaacaacggcaaaaacaaacgggucuucauagaacccauacccaacuuccgccaaguagcaaagaagcaccuagaagaaaucuucaucucccacaaagccaaaaauaaagucguaacgaagaacacuaacaaacccgcaggaaccaacaagcaacaaauaacacuaacucccagaggacaacuccacaaagagaccauauauggaaaguaccaguacuauguaaacaaggaagagaaaguaggugucaaauucgacaaagaaacaaucgcaaagguaucaaauccccuguacagagaagcacuacugaaacgcuugcaggcaaacgacaacgacccaaagaaggccuuuaccggcaaaaacgcacuaagcaaaaacccuaucuaucuggacgaggccaagacaaagacccuacccgagaaggucaaccucacauaucucgaagaggauuucucgguaagaaagaaaaucguacccaaaaacccaacaucuaaagaguucguuccaaaccugaaaagcaucgaaaaagugguagacgaaggaguacgaaacauccucaucgaacgccucagaguuuacaacaacgauccagagaaagcauuuguugaccuagagaaaaaccccauauggcuaaacaaggaaaaaggcauugcaaucaagcgugucacaauaagcggcgucaacaaugcccagccccuacacaucggcaaagaccauuuggguaaaacaacgcugaacaaggaaggcaaagaaauaccaguagacuauguaagcacgggcaacaaccaccauguagccaucuaucgggacaaagaagguaaccuccaagaacaaauaguaucguucuucgaagccgugguaagaacgcaacagggucucccuauaaucgauaaaacguacaagcaggaagaaggcuggcaauuccuauuuacaaugaaacaaaacgagauguucguguuccccaacgaagcgacuggauucaauccagcagaaauagaccuacuggaccccaagaacaagaaacaaauauccccaaaccuauuuagaguacagaaaaucgcaaccaaagacuauuucuuccgccaccaucuugaaacgaacguagaaacagauaaugugcucaaaaacacgaccuggaaacgagaaggccuaaguggacucaaagacaucguaaaaguacgaaucaaccaccucggagacaucgucagcaucggcgaguacuga

SEQ ID NO: 6833 - RNA, 4302 nt, Artificial Sequence
  Cas9 variant
augaagaaaaucuuaggccucgaccuugguaccaccucaaucggcuacgcgcaggucaacgaaagcgaagacuucaaagacagcucaauagaacguaucggcguccgcgucaacccccuuagcgucgacgaacaaacaaacuucgagaagggaaaaccgauuagcauaaacgccgacagaacccugaaaagcggcgcccgacggacgcucgaccgcuaccaggaccguagaucgaaucuaaucgacgcacucgucaagagcgucaucaucaccgaagacaccgugcucgcggaagacggcaaaaacacaacacauagcaccuucgcgcugagggcaaaaagcgcaucagaaaaagucgaaaaagccgaguucgcacgcauccuacuugccaucaacaagaaacgcggauacaaaucgucccgcaaaaccaacaacaacgacgaugaaggccaagccaucgacgggauggccaucgccaagaaacuuuacgacgagaaccuaaccccgggccaacucgcauaucaacuguugaaggagggaaagaaauaccugccagacuucuaucgaagcgaucuacaagccgaguucgacaagauauggaccuuccagaaacaauucuaccccgaaauccugacggacgaacuccagaaggaacuagcgggcaaaggucaacgcgcgacgucagccaucuuuuggaagaaguacgacuucaacaccgccgagaacaagggaacgcgagaggagaaaaagcugaaagccuacgaauggcgcuccacaucgguugacaagaagcugcaaaaagaagagguagcauaugucaucacagaaaucaacaauaaccugaccaacaguucaggguaccuaggagccaucagcgaccgauccaaagagcucuacuucaacaaacaaaccgucggccaauaccuguucaagcagauccagaaaaacccccacaccaaacuuaaaaaccaaguauucuaucgccaagacuacuucgacgaguucgaaaucaucugggaaacacaagccaaauuccauccugaauuaacggaagaacuaaagaacaagauaagagauaucaucauauucuaccaaagaaaacuaaaaucucagaaaggccucauauccuucugcgaguucgaacggaaagagguagaaaucgaaaaaggcggcagacgcaugaagaagacaaucggacuaaaagucgcaccuaaaagcagccccuuauuccaggaguucaagaucuggcagguccucaacaacguacuaaucagaaagaaagguuccaaaaagcgccgagucaaggaaccggaccagcucaaccuggucgaacaggaacaagaggucauguuuuucgacaugcagaccaaacaaacccucuucgacgagcucaacguaaagggaaaccuaaaggccaaacgcauaaucgagcucauaggucaagacgcgaacgacugggagaucaacuacagugagauagaggggaaucgaacaaacaaagcccucuacgacgcguacuuaaaaauacucgacuuagagggauacgauaccaaagcacuacucgacgucaaaaccagcaaagaugaaguugaacuugacgacaucaacaucagcggaccagaagucaaagaccuaguaaaacgcauauucgagucacuagaaauagacacccagauacuagaguucgaugcggaacucgacggggaagucuucgaaaagcaauccagcuaucugcuguggcacuuacuauauuccuacgaaggcgacgacucuccgaguggcaaugaaaaacucuacaaacuccuuaagcagaaguucggauucaagaaggaacacgcgcaaauacuagcgagcaucacccuaucggacgacuacggaagucucucagcaaaggccaugcgcaagaucuacccguacauaagagaacaaacguucgacaaagcugccagccuagccggauauagacacagcgccaguucacucaccaaagaagaaauugcgaacaggccacucaaggacaagcuagagcucaucaagaaaaauucgcugagaaacccagucgucgagaaaauccucaaccaggucgucaacaucguuaacucgcuaaucgaagcaaacucugaaaaggacucagacggcaacaucaucagcuacuucaaguucgacgagauucgaaucgaacucgcacgggaccucaaaaagaacgccaaagaacgggcggaaaugacacuaaacaucaacgcugcaaagaucguacaugaaaagaucuucaaacuccuccaagcugaguucggggugaagaaccccacccggaacgacauaauccgcuacaagcucuacgaggaacucaaaaacaacggauacaaagaccuguacacaaacaucuacauaccgcgagaaauccucuucagcaaacaaauagacauagaacacaucaucccccaaucuaaaauguucgacgauucguucuccaauaaaacgauaguauuccguaaagacaaccuagacaagggaaacuccacggcuuucgacuacauagacagucgcuucggcaaagacaaacuaacagauuucgaacaacgaaucgaguuccucuucgaacaaggaaagaaaaacaaagaagagggaauaaguaaagccaaauaccagaaacuguuaaaacgagaggcugacaucggcgacggguucauagaacgagaucuccgagacacccaauacauagcaaagaaagcacguaaccuccuguacgaaaucugucguauaguaacaccgaccaccggcagcauaacugaccggcuccgggaggacugggaccucguaaacauaaugcaagagcucaaccuagacaaauucaagaaacucgggcucaccgaaaugguagagaagaaagacgggucauucaaagaacgcauaguagauuggucaaaacgcaacgaccaucgccaccacgcgauggaugcacucaccaucgccuuuaccaaacauagucauauacaguaccuaaauuaccuaaaugcccgcaaaaacgagaaccauaaacagcaucacaacaucaucggcauagagagaaaagagacagaguucgugauugacgaccucgggaacaaaaagcgcaaauuccaccuaccccuccccaacuuucgugaagaagccaagaaacaccuagaaaauguccuagucucguuuaaagccaaaaacaaggucguaacaaagaacaagaauaaaacggccucauccaaaggcgagaaaauuaaaguggaacucacgccccguggacagcuccauaaagaaacgguauacggaaaguacaaauucuacguaucgaaggaagaacggaucggcggaaaauuugaucagcggaccaucgagcgcguggcaaacagcacacauaagcgacuacugcuccaacgucuccuagaaaacgauaacgaugcaaagaaggcauucacagggaaaaacgcgcuugcuaaaaaucccaucuaccuggacgacaccaagacccuaacccuacccgagaucguaaaacuaacguggcuagaagaagacuacuccauacgcaaagacaucacaccggagaacuucaaagacaucaaaguaauagacaaaauccuagaugaaggaguaaaaaggauccuaaaagaacgacuagcgaagcacaacaacaacccuaaggaagcauucuccgaccucgagaaaaacccgaucuggcucaaugagaaaaagagcauuuccaucaaaaagguaaagauaucgggcauaaacaacgccgaagcccuacacuacaagaaaaaccaccugggcaucgaaauacuagaugacgaaaagaaaaggauuccggucgacuuuguaagcaccggaaacaaccaccacgucgccaucuaucgggacgaaaaaggcaaucugcaagaagacgucgugagcuucuucgaagccguggcucgcguuaaccaaaaccugcccaucaucgacaagacccucaaagcauaccucgguuggacauuccuauucacaaugaaacaaaacgaauacuucauuuucccgaacaagcagacaggguuuaaucccaccgagaucgaccuccuagacucgaugaauaacaaacucaucagccccaaccuuuuccggguccagaaauucaccgugaaggacuacuucuuucgccaccaccuggaaaccaaugucgaggacgacuccaaacucaaaaacacgacauggaaaagagaaggauuaggagguaucggcaauaucguaaaagugcgaaucaaccauauaggacagaucguaaaaaucggagaauacuga

SEQ ID NO: 6834 - RNA, 4305 nt, Artificial Sequence
  Cas9 variant
augaaaaacauacuaggccuggaccucggcacgaacaguaucggcugggcauacguaaagcaagcgcaaaacgauuccgaaaagagcgaaaucgccgaguuggggguuagggucaacccccuuaccgucgacgaaaagacuaacuuugagaaaggaaaacccaucaguacgaaugcugacagaacccuaaaacgaggcgcgagacgcaacuugcagagguacaaacuacgacgccaggagcucauagaacugcuaaaggacuaucaaguuaucuccgacaaaacgauccuagccgaagacggaaaggagaccacauucgaaacacuccgacuucgcgucaagagugcaaaagagcaagugagccuagaagaacuggcccguauccuccuaaugaucaacaaaaagcguggauacaaaucguccagaaaagccaaaaacgaggacgagggacaacugaucgacggaauggagaucgcaagacgacuauacgacgaaaaccucacuaccgggcagcucagccugcaacuccuaaaggaaggcaagaaaagccuacccgacuacuaucgcuccgaccuacaacacgaacucgacaaagucuggaacuuccaaaagcaauuucaccccgacauccuuaccgacgaguucuacaccucaauccaggguaaaggccaaaaggcgacucgcgagagcuucaguagcaaguauggcaucgacaccgcggaaaacaaagguagccgggaagagaagaaacugcaagcauaccaauggcgcgcggacgccacccacaaagaacucaccaaagaggaacuagccuuugucauaacugagaucaacaacaauaucaacaauucaucgggguaccuaggcgcgaucucggaccgcagcaaagaacucaucuuugcaaacgaaacaguuggcgaguaucucuggaagcagauacaaaaugacccccacacuucucuaaagaaccagguguuuuaccgccaagacuacuucgacgaguucgagaggaucugggaaacgcaaucuggauuuuacccccaaauccucaccgaaucccucaagaacgaacuacgcgacauacuuauauucuaccaaagaaaacucaaaucacagaaagcccuagucucgaucugcgaguucgaaagcaaggaaauuccacucaaagacaagcaggggaacccaauauccaaaaacggcauccccgucacaaagcuaguaggcccuaaagucgcacccaagagcuccccacuauuccaagaguucaaaaucuggcagaaccugaacaacguacucgugcgccccaaggggagccgaaaacgaaaggucaccacgaaucaacaaucgacccugcuagaaggacaggaaccagucuucgaguugaaccucgaacaaaaagaacuccucuucgaagaacuuaaccucaaggggaaccucaaaaccgacuacugccuagagcuaauaggcuauagcgccaaagaaugggaaaugaacuacccuacacucgagggaaacaaaacaaacaaagcacuuuacgaagcauaccuuaaaaucaucgacuccgaaggcuacgacgccaaaaagcuccucaaaguaaagacagacaaggacgacaucaaucucgacgacauaaaagugucagccucagagaucaaaacgaugaucucggauauauucaacgaauuaggcauaaacacaaagauccucgacuucgacgccgaacucgagcguaagcaguucgaagcacaggcaagcuaccgacuauggcaucuacuauacucauacgaaggggacgacagcaaaucaggcaacgaguugcucuacagacugcucgaggacaaguucggauuuaaaagagaacacucaaaaacacucgccaaugucucacuccucucagacuacggcaaccucagcacaaaggcaauacgaacgaucuaccccuacauuaaagaaaauaaauucucaacagccugcgagcucgccggcuaccgccauagcaaauugagcaucuccaaagaagagaacgaaaaccguacccuaaaagacacccuagacgugcucaaaaagaacaguuugcgccaaccaguagucgagaaaauacucaaccaaaugaucaaccugaucaacgaacugaucgaaaaacacagcgagaaagaugaaaaaggaaacauugucaaguacuuuaaauucgacgaaauacacaucgaauuagcccgugagcuaaagaaaaacgccgaagaacgaagagaacuggacuccaaaguuagagaagguaaagacagaaacgagaaaauaauaacaauccucaagucagaguucggccugcccuacccaaccaaaaacgacauaacacgcuaccgacuuuacgaagaacucaaagauaauggcuacaaagacuuauacaccaacacauacaucccccgcgaaaaacuauucagcaaagaaaucgacauugaacauaucauccccaagucacguuuguuuaacgacaguuucaguaacaaaacaaucugcuaccgccaagacaaccucaacaagggagaacgaacggcguacgacuacauagaaggauugggcaagacacaacuggacgaauaucucaaccgcgucgaaaaccucuacacaaacaaguucaucacuaaagcaaaguaccggaaccuccucaagaaagagucagaaauaggagauggcuucaucgaacgugaccuaagagaaacgcaauacauagcgaaaaaggcaaaggagaugcuccuccaaauaaccagacacguaguaagcacaacaggaagcauaacagaccggcuuagggacgauugggagcuagucaacguaaugcgagaacuaaaccucccuaaguauaaaguacucggccucaccgaaauacaagagcgcaagaacggacagacaguggaaguaauaacagauuggaccaaacggaaugaccaccgccaucacgcaauggacgcgcucaccguagccuucacaaagcacagccacauucaauaccuaaacuuccugaacgcuaggaaagacgagaaacacaaggaguauuccaauaucaugggcauccagcaacucgaaaccgagaaaaccaccgacaaagauggaaaagaccggcgagucuucaagacgcccauccccaauuuccgacaagucgccaaagaacaccucgaauccauccucaucagccacaaaaccaaaaacaaaguugucacaagagccacaaacaaaaucgccggcagcaaaaagcagcaggagacacuaucuccccgcggacagcuacacaaagagacagucuacggaaaauauagaagauacguccaaaaagaagagaaaauuggaaguaaguucgaccuccagacaaucgaacgcguagcuaacccucucuacaaacgccuacuaacgaagcgccucgaggaaaacggaggagacccgaagaaagccuucaccggcaaaaacgcccucgccaaaaguccuaucuaccuagacgagacccagacucaacagcuucccgaaaaaguuaagcuagucuggcuggaaacagacuucucgauccgcaaagacaucacccccgacaacuucaaagacgaaaaaucgauagacaaaguccuggacgaaggcaucaaacgaauccucaaagacagacugaagucguucgacggggaugcaaaaagagccuucacugaccuagaacaaaaccccaucuggcucaacaaagaaaaaggaaucgcaaucaaacgugugacuauauccggcgucaguaaugcggaaccccuccacacuaagaaagaccaccucgggaacgaaaucuucgacgacacugguaaaccaaucccagucgacuacguaagcacaggcaacaaccaccacaucgccauauaccgcgaugagaauggaaaccuccaagaaaaagcagucagcuucuuugaagcagucacacgcgccaaucagggccuaccaaccguagacaaaacguacaaccaacaccugggauggcaguuccucuuuacuaugaaacaaaacgaaauguucgucuuccccaacaaagaaacgggauucgacccacaagagaucgaccuacuagacccgaagaacaagaaacucaucucccccaaucuguucagagugcagaaaaucuccaccaagaacuauuucuuucgccaccaccucgagaccagcgucgaaacccauaacgccuuaaacggcgucacauacaaaucucaacucggccuaaacgggauaacggauaucauaaagguccgcaucaaccaccucggagauaucguccacauaggcgaguacuga

SEQ ID NO: 6835 - RNA, 4308 nt, Artificial Sequence
  Cas9 variant
augcugggaugcgagcgcaagcgcaaacgccgcgagaaagaaaagauggccaaaccaaaggacuacacaaucggacuagacauugggacgaacucgguaggcugggucgugaccgacgaccaaaacaacauccuccgcauaaaagggaaaaaggccauaggcgcucgcuuguuuaccgaaggcaaaguugcggccgaacgacgaucauuccgcacaacgagaagacgccuaucacgucgacgauggcggaucaagaugcucgaggaacuauuugacgaagagauagcaaagguagauccauccuucuucgcuaggcugcacgaguccuggauaucccccaaagacaaacgaaaacgcuacucggcuauagucuuccccucaccggaagaagauaaaaaguuccacgagucguaccccacgauauaccaccuacgcgacaaacuaaugaaagacgaccaaaagcacgacauacgcgaaauauacaucgcaguacaccaaaugauaaaagcccguggcaacuuccuccacgaugaaucuguggaaaccuaccgcucaggaauguccagccuagguggccgaagcgaaagaaacauccuguccgugcaaacccuagaagaauuaaacgaccuguuugcagaaaacgaaggcaccgaagaaguagagcucaacgucgccagcgccgaacagaucaacgacauacuaaccggcggacaccuuaacgcggacucccaaaaagagauaaguaaccuccugcuuccguccagcuuccccuccuucgacgacaaggccaaggaaaaacaggugaagaaacucauuaacaacguugcaaccaacaucucgaaggcguggcugggcuauaaagcagacuucagcaccauccuuaaccuagcgaagguggacaaagaccaaaagaaaaucuucgcauucgcacuucaaggaggggacgaggaagacaaagugcaagagcucgaaucccuccucgagcagucacaaaccgacaucguagaccgucucauagaaauacgucacgccauagugcucagcgagauaguacccguugguaugacccucucagaagccaugaucgacaaguacgaccagcacaaggaagaucucauuacgcugaaagcuguaauccgcaacaccaaggacaaaaagaaagccgcaaagcuacaagcaaucuacgaucucuacgugaaaaaccgccacgcugaccucgcaaaagccaugaaacuuacgggaaucaagaaacgcuccgaacugcuggacccggaagaacucaagaaggggaucuccucccuccucgacgacuccccagaagcaguggaaaucaaacaacgacucgaagagaaaaccuuccugccgcuacagcgcagcaacaacaauggagucauuccgaaccaacuucaucaaguagagcucgacgaaaucaucaaaaagcagucaaaauacuaccccuuccuagccgagaaaaauccugacgaaagcgaagaagcgcaaaagaaagcacccacaaaauuagacgcacuccuaacauucagggugcccuacuaugucggcccaaugauaaccaaagaagaacaagaggcccagaacggccacucguucgccuggaugguucgccgggauccucaagaccacgaggcgauaacccccuggaacuucgaaaagaaagucgacaaaauggcuuccgcaacgcaauucauaaagcguaugaccaccaaagacacauauuugcugggagaagacguacucccagcguccucccuaaaauaucaacuauucacuguauuaaacgagcucaacaacuuaagagucaacggaaagaaacugacauccgacgaaaaagagcagguaaucgaggggcuauucaagaaacagaaaaccgucaaagcggauaaauuugucaaguacuggcaggccaagcacauaggagcagauauaaaagucaaggggcucucggauccuucgaaauucaauuccaccaugagcacuuacaucgacuucaagaaaaucuucggcgaucagcuaaacgacgucaaccgccaaaacgacuucgaaaagaucauagaauacuccacaaucuuugaagaccggaaaauccucgaagacaaacuacgggucgacuucgcaugguugagcgaggaacagauuaaacagcugugccgacuccgccuccagggcugggggcgacucagugacaaacuucucacccgccuaaccgacgcggacggucagaacguccucgaacgccucuggaacuccaaugacaacuucgugcagauagugagcgaucccaauaucaaggcuaagauagaacaagaaaaccaaaaacugcuacgagacucacaaagcgacaaugcggucgaaagcauccuggacgacgcauauacaucaccccaaaacaagaaagccauccgccaggucaugcgcgucguccacgauauagucaaagcgugcgacgggaacguaccggcaaaauucgcuaucgaguucgcccggucccaagaagacgacccaaaaagaacaacagcaagagucaaccagaugcagaaaauauacgaccaaauaucagacgaagucgugagccaaggaguaaaagaacagcucucaggaaugaaaagccuuaaagaccguuacuaccucuacuuuaugcaaggaggccgcgacgccuacacaggggccaagcuaaacauagaccgacucucggacuacgacguggaccacaucaugccgcagagcuucguuaaagaugacagccuagacaaccgcguacuugucgcgcgggccgucaacaaccagaaaagcgacaaaguacccgcccuacuauucgguaacaaaguagucgccgaucucggaauuaccguacgagagaugugggacaaauggcaaaaacuaggcaugaucuccaaacgaaaacuuucaaaccuguuaacggacuccgacgcucuaacagaauacagagcacaaggauucauccgacgccagcuaguagaaacaagccaagugauaaaacucaccgcaacaauacuccaaucagaguuccccgacucaaaaaucaucgaggucccagccaaauauaauuccauaguacgaaaacaauucgaccucuacaagucaagagaagugaacgacuuccaucacgccauagacgccuaccucaguacaaucgucggcaacuaccucuaccaaguguacccaaacuuacgacgcauguucguguauggcgaguucaagaaauucucaagcaaugcugaagaaagcgcccacgacgucgcacgccgcguaaagagcaugaacuuccuagacgaucuccuaagggggacccacggggacaacaucuacugcagaagcacaggcgaaauaguguuuaaccgcaacgacaucauuucgaagcugaagcaagcauacuccuucaaacaaauguuggucacccaggaaguauuuaccaagaaaucggcucuauucaaccagaccguguacccaucccccaaacgcgauggcucaaaacgcucggguuuaaucccucgaaaacgcggcauggaccccgaaauauacgggggcuacgcacacaaccaagacuccuacuucguacuagcaaaaauagagaaggugaagggguacacucuacagaucguuggcguccccauccgcucccuggagauaauuaauaaggcagaagacuucagcaccgcccuacucgacaucaucaaaagcaaggugauguacaacgaaaagacgggacagcccaaaagaggaauuaaaaacguagagauccuggugaacaaacuaccauaucgccaaccaauacuagaaaaagacguauccuacaugcugggaucguccgccuacaaguauaacauuaaacagaucacgcucagccgccaaucgaugaaauacauacucgacuacaucgacgaccccaacuucacaaaacaugaaaugacaaugaucgaugagcagaacgaacgcgagugccuucugaguguauacgacgagauccucgaaaagguagacaaauaccuaccacucuucgacggaaauaaauuccgcgaaaaauuacacuccgcacgaaaagaguucguaucccucuccguagacgacgaagcgucagcaauagaaaagauucuccggggacuccacgccaacagugaaaugccaucccucgaaaaccucaaaauaaaacccgccuuaggcuuuuuccagaugaaaaacggcauaacacuauccaacgacgcuguccuccucuaccaaagccccaccggacucuucgagcggagaguaaaagucagcgaccugcuaaaauga

SEQ ID NO: 6836 - RNA, 4308 nt, Artificial Sequence
  Cas9 variant
augaaaaacauauuggggcuugaucuaggcaccaccucgaucggcuuugcccacaucguagaggacgaaaauaaagaaaaaucagaaauaaaagaacuaggcgucagaaucguuccccucaccaccgaugaacagagcgauuucgaaaaaggcaaaucaauuaccacaaacgccaaccgcacccucaagcacggcgcccgccucaaucuagaccgauaccaacaaagacgcaaguacuuaauagacuugcuccagaaggccaaccucauaacuucaucaucaauccuggccgaaaaugguaaaaauacgacacacucaacuuggcagcuccgcgcaaaagccgucacagagcggaucgaaaaagaggaauuugcacggguccuccuggcaaucaacaaaaagcgcggcuacaagagcagccgaaaagccaagaccgaagacgagggccaagccaucgacggcauggcaaucgccaaacgcuuguacgacgagaaccucaccacgggucagcucagccuccaacugcuacaacaaaacaagaaacuccugcccgacuucuaccguagcgaucuucaaaaagaguucgaccucgucuggaauuuccaaaaacaguucuacccugacauccugaccgacagcuucuauaaggaacuccaaggaaaggggaaggacgcuaccucgaaagcauucagcaagagauaccacuucgacacagccgaaaacaaaggauccaaagaaucaguccgacugcaagcauaccaauggcgcguggaagcaauaucaaaacagcucagcaaggaagaagucgcauacguccuaacagaaaucaacaauaaucugaacaacgccucuggauaucucggcgcuaucucugaccgaaguaaggaauuauacuucaaccgccaaacagucggacaauacuuguacgcgcaacugcaggaaaaucgucacaacagccuuaaaaacaaaguguucuacaggcaagacuaccuggacgaguucgaacguauuugggaaacccaggcaucauuccacaaagaacucaccgaagaacucaagaaacaaauacgcgacguggucaucuucuaccaaaggaaaccgaaaucccagaaaggccucauuuccuucugcgaguucgaaagcaaagaaauagaaauagaaaaggacggcaagacgaucaccaaaacaaucggcgcccgcguagugcccaaaagcagcccacucuuccaagaguucaagaucuggcaaauacugaauaacgugauaugcaaaagaaagggcauccgcaaaaagaaagucagcgcuaagacuacccagcucgaccuccucaacgaauccucacagaccaucuucagucucgacauggagugcaaacaacuccuauucgaggaacuuaaccucaaaggagaccucaaaagcgacaagguccugaagcuguuaggcuacuccccgcaggaaugggagaucaacuacaaccaguuggaaggaaaccggacccaaaaagcccuguacgaggccuaccuaaagaucgucgaaauggaggcacaugacgucaaagacauccuccagauaaaaagcgccaaggacgacuggagucuggacgaguccccacuaucggccagcgagauacgcgagucagucaaagcuaucuuucaagcccucggcaucugcacaaagauacucuacuuugacccacuccuccccgugaaggaguucgaaaaacaagacagcuaccaacuguggcaucuccuuuacuccuacgagucggacgacagcaccucaggcaacgaaacacuguacagaauccuagaaaagaaauacgcguucaaacgcgagcacguccgaauccuugccaacgucgcacuacaagacgacuacggaagccucucaacgaaagcaaucagaaagaucuacccgaacauaaaggaaaaccaguauucuauugccugcgagauggcaggauacaaacacagcaaacuaucucucacuaccgaagaacuagaagcccgcgagcucaagaacaucaucccccuccuaaagaaaaacgcgcugaggaaccccgucgucgagaaaauccuaaaccagaugaucaacguggucaacgcgcuaaucgagaaaaacagcgaacgcgacgccgaaggaaaaauaacaaaguacuuccacuuugacgaaauccguaucgaacucgcccgagaacucaagaaaaacgcucaaaaacgcuacgaaaugacucaaaacauaaacaaagcuaaacucgaacaccagaaaauuucggaaauccuacaaaaacaauucgggaucaaaaaccccaccaaaagcgacauaaucagguaccgacuauaccaagaacucgaacauaacggauacaaagaacuguacacaaacgcuuacaucgccccugauguccuauucagcaaaaacaucgacauugaacacaucguacccaaggcccgaguguucgacgacuccuuuucaaacaagacccuggcguucagagaguucaacaucaagaaaggagaaucgacagccuucgacuacaucaccucgcuaaacuccgaagaagaauuaaaccaauaccugacccgaguagaaaaugcguacaaaacaaaaucgaucuccccaacgaaauacaagaaccuccucaaaaaggcgucagagauaggagacgacuuuaucaacagggaccuccgagauacccaauacauagcaaagaaagcaaaagaaauccuguuccaaguaaccaaaaacguacuuucgaccagcgggagcaucacugaccgacugcgcgaagacuggggacucgucgacguaaugaaagaacugaacaugccuaaauaucagagccucgggcucaccgaggucgaagaacggaaagacggaaacaaaguaacaguuaucaaaaauuggaccaagcgcaacgaucaccggcaccacgcaauggaugcccucaccguggcguucaccaagcccucauacauacaauaccuaaaccaccucaacgcgagaaaagacgaaaacaacaaaaacuauucaguaauacuagccauagaagaaaaagagacuauuaaaguacgaaccaacaacgguaaaaacaagcgcgucuucauugaacccaucccgaacuuccgccagguggcgaagaaacaccuagaagagaucuucaucagccacaaaacuaaaaacaaagucguaacuaaaaacgucaauaaacccgcaggaaccgacaaacaacaaaucacacuaacaccccgcggccagcuucacaaagagaccaucuacggaaaauaccaauacuacgucaacaaagaggaaaagaucggcgucaaguucgauaaggaaaccaucgccaaagucagcaacccccucuaucgggaagcucuacucaagagacugcaggccaacgacaacgaccccaaaaaggcauucacaggcaaaaacgcucuaucaaagaagcccaucuaccuggaugaauccaagacaaaaacccuccccgagaaggucaaucucacuuaccuggaggaagauuucagcaucagaaaggauaucagccccgauaacuucaaggaccuaaagucaaucgagaaaguaauugaccagggcguaaaacguauacuaaucaagagacuccaagccuacgacaacgacccaaagaaagccuucguggauuuagagaaaaacccaaucuggcugaacaaggaaaaaggcaucgccaucaaacgcguaacaauuuccggcguaaacaacgcucagccccuacacauaggcaaagaccaccucggcaagacaacccuaaacaaagaagggaaggaaaucccggucgacuacgugucgaccgggaauaaccaccacguagccauauacagggacaaggaaggcaaccugcaggaacaaaucgucuccuucuucgacgcgguuguccgcgcccaacaggggcucccuaucaucgacaagaccuacaagcaggcagaaggcuggcaguucauguuuacaaugaaacaaaacgaaauguucguguucccaaaugagaccacagguuuuaacccagccgaaaucgaccuccuagaccccaaaaauaaaaagcucauaucaccaaaccuauuucggguacaaacgauaaguguagucaaauacggaaacagugucguuagagauuuuaaguucagacaccaccuugaaaccacacuacaggacgacaaaauacuccaaggcaucacguuccagcagaucaaaagucucgaaccacuccgcaauauagucaaaguaagaauaaaccaccucggagauauugucucaauaggcgaauacuga

SEQ ID NO: 6837 - RNA, 4308 nt, Artificial Sequence
  Cas9 variant
augaaaaacauccuaggccucgaccucgggaccacauccauaggguucgcccacauaguagaggacgaaaacaaagaaaagucggaaaucaaagagcucggcguccgaauaguaucccucgccaccgacgaacaauccgacuucgagaaagguaaaaguaucuccaccaacgcuaaccgcacccugaaacacggcgcgcgccuuaaccuagaucgcuaucaacagcggcguaaauuccuaaucgacuugcuacaaaaggcuaaccucaucacaucagccucuauacucgcagaaaacggcaagaacacaacccacagcaccuggcaacuacgugcaaaggcugucaccgaacgaauagaaaaagaagaguucgcccgaguccucuuagccauaaacaagaaacgaggcuacaaaaacucgcgcaagacaaaaacugaagacgaaggacaggccauagauggcauggcuaucgcaaagugccuguacgaugaaaaucuaacacccggacaauugagccuccaacuacuccaacagaauaagaagcuacuaccagacuucuaccgaagcgaccugcaaaaggaguucgaccuagucuggaaccugcaaaaacaguucuaccccgacauacugacagacuccuucuacaaagaacuucagggaaagggaaaggaugccaccucaaaagcauucucgaagagguaccacuucgacacugcggaaaauaaggggagcaaagaaagcguccgauugcaggcguaccaauggcgcgccgaagcaaucucaaaacaacucucaaaggaagaagucgccuacgugcuaacagagauaaacaacaaccuaaauaacagcuccggcuaccuaggggccauaagcgaucgauccaaggagcuauacuucaaccgccaaacagucggccaauaucuauacgcccagcuccaagaaaaucgccacaacucccugaaaaauaagguauucuaccgccaagacuaccucgacgaguucgaacgcaucugggaaacccaggccuccuuccacaaagaacuaacagacgagcuaaagaaacagauccgggacgucguaaucuucuaucaaagaaaauuaaaaucacaaaagggccuuguauccuucugcgaguucgaaagcaaggaaaucgaaaucgaaaaagacggcaaggccauaacgaaauccaucggcgccagggucgugcccaaauccuccccgcuuuuucaagaauuuaagaucuggcaaauacuaaacaacguaacuugcaagcggaagggcauccgcaagaaaaaguccagcgccaaaagcaccgaacuagaccucuucaacgaaccaucgcagagcauauucucacuagacauggaguguaaacaacuacuguuugacgaacucaaucucaaaggggaccucaaauccgacaaagugcuaaaacuucuaggauacucgccccaagagugggaaaucaacuauaaccaacuagagggcaaccgaacucagaaaagucuauacgaagccuaccucaaaaucaucgagauugagggcuacgaaguaaaagacauacuacaaauaaagucaaccaaagacgauuggagccuagacgaaagcccccuguccgccucagaaaucagagaacgagucaaagucaucuuccagacacuggggaucuguaccaagauccucuacuucgacccccuucuaccugucaaagaguucgaacaacaguacagcuaccagcucuggcaucugcucuacaguuaugaaucagacgacuccaccagcgggaacgaaacucucuaccggauccuagagaaaaaguaugccuucaaaagagaacacgcuacaaucuuagcaaacgucgcccuccaagaugacuauggcucccucucuacgaaagcaauccgcaaaaucuaccccuacauuaaggagaaucaauauaguacagcaugcgaacuggcaggcuacaaacacucuaaacuaucgcucacaaccgaagaacuggaagcucgcgaacugaagaacaucaucccacugcuuaagaaaaacgcccuaaggaaccccgucguagaaaagauccucaaucaaaugaucaacgucgugaacgcucuaaucgagaaaaacucugaacgagaugccgaaggaaaaaucaccaaauacuuccacuucgacgaaauacgcaucgaauuagcgcgagaacucaaaaagaacgcccaggaacgcuacgagaugacccagaacaucaacaaagcaaagcuagaacaccagaaaauaagcgagaaacugcaaaagcaauucggcauuaaaaaccccaccaaaucagacauaauccgcuaucggcuguaucaagagcucgaacacaacggauacaaagaacucuacacgaacaccuacauagcacccgacguccucuucucuaagaacauugacauagaacacaucguaccaaaagcccggguauucgacgacucauucagcaacaagacguuggcuuucaaagaguucaacauaaagaaaggcgaaagcacggcauucgacuauaucaccucccucaacugcgaaggcgaacuaaaccaauaucucacgcgagucgaaaacgcauacaaaacaaaaucgaucucccuaacgaaguacaaaaaccuccucaagaaagcgucggaaauaggagacggcuucaucaaccgagaccuccgagacacucaauacaucgccaaaaaggcaaaagaaauacucuuucaagucacgaagaacguacugucuacaucggguagcaucacagaccgccucagagaagauuggggacuggucgacguaaugaaggaacugaacaugccgaaguaccagagcuugggccuuacagagguagaggaacgcaaggacggcaacaaagucaccgucaucaaagacuggacaaagcguaaugaccaccgccaccaugcaauggacgcacuuaccgucgccuuuaccaaacccagcuauauccaauauuugaaccaccugaacgcccggaaagacgaaaacaacaagaacuacagcgucauccucgcaauagagaagaaagaaaccauaaaaguacccaucaacaacgguaaaaacaagagagucuucauagaacccauacucaacuuccgccaaguagcuaaaaagcacuuggaagaaauuuucaucucacacaaggcaaagaauaaagucgucaccaaaaacaucaacaaacccgcaggcaccgacaagcagcaaauaacacugacaccacgcggucaacuccacaaggagaccaucuacggaaaguaucaauacuacgucaacaaggaggaaaaagucgggguaaaauucgaugagcggacgauaaccaaagucucaaacccccucuaccgcgaagcucugcucaagcgccuucaagccaaugacaacgaccccaagaaagccuucgcagguaaaaacgcacuguccaaaaaccccaucuaucuggacgaggccaaaacgaaaacccucccggaaaaaguaaaucuaaccuaccuggaagaagacuucagcauaaggaaggauaucagccccgacaauuucaaggaccuaaaaagcauagaaaaagugaucgaccaaggaguaaaacgcauacugauuaagagacuccaagcguaugacaacgacccuaaaaaggccuucgucgaccuagagaaaaacccaaucugguugaacaaggaaaaaggcaucgccaucaaacgcgucaccaucuccggcgucagcaacgcgcaaccacuucacauaggcaaagaccaccuugguaaaaccacguuaaacaaagaaggcaaggagguacccguagacuacguuagcacaggcaacaaucaccacgucgcuaucuaccgggacaaggaagggaaucuacaagaacagauaguauccuucuucgaagcagugguacgggcccagcagggccugccuauuauagacaagaacuacaagcaagccgaaggguggcaguucauguucaccaugaaacaaaacgaaauguucguguucccgaacgaagccacgggcuucaacccggccgagaucgaucuacuugauccaaagaacaagaaacucaucucuccaaaccucuuccgaguccagacaaucuccauuguaaaguauggaaacuccgucguacgggacuucaaguucaggcaccaucucgaaacaacacuccaagacgacaaaaucuuacaaggcauaacauuucaacagauaaaaucacucgaaccacugaggaacauagucaaggugcgcauaaaccaccuaggggacauagucaauaucggggaguauuga

SEQ ID NO: 6838 - RNA, 4311 nt, Artificial Sequence
  Cas9 variant
augaaacgcauucuaggccucgaccucggaacgaacucaauaggaugggcccuagucaacgaagcagagaacaaggacgagcgaucgagcaucgucaagcucggcguacgaguaaaccccuuaaccgucgacgagcuaacaaacuucgagaagggcaaaagcauaacaacaaacgcggacagaacccucaaacgcggaaugagaaggaaucuacaacgauauaagcuccgacgcgaaacacucacggaggugcuuaaagaacacaagcucauaaccgaagacaccauccugucagagaacgggaaccgcaccaccuucgagaccuaccgacuacgagcgaaagcaguaaccgaagaaaucucgcucgaagaauuugcacgaguucuacucaugauaaacaaaaagcgaggauacaaaucaagcagaaaggccaaaggcguggaggaaggcacgcucaucgauggcauggacauagcccgagagcucuacaacaacaaucucaccccuggagagcuauguuuacaacuacucgacgcaggcaagaaguuccugcccgauuucuaccggagugaucugcaaaaugaacucgaucguaucugggagaaacaaaaagaauacuacccagagauacucaccgauguauugaaggaagaacuccgagguaagaaacgcgacgccguaugggcaaucugcgcaaaauacuucgucuggaaagagaacuacaccgaguggaacaaggagaaaggaaagacggaacaacaagaaagagaacacaaacuugagggaaucuacagcaagcgcaagcgcgacgaagcaaagcgagaaaaccuccaauggcgagugaacggacucaaagagaagcucucccucgagcagcuaguaaucgucuuccaagaaaugaacacgcaaaucaacaacagcucuggauaccugggcgcaaucagcgaucgaucuaaggaacuauacuucaacaaacagacaguaggacaauaucaaauggaaaugcuagacaaaaauccuaacgcuucgcuaagaaauaugguauuuuaccgccaagacuaucuagacgaguucaacaugcucugggagaaacaagcagucuaccacaaggagcucaccgaggaacucaaaaaggaaaucagagacaucauaauauuuuaccagagacgacuaaaaagccaaaaaggccuaauaggcuucugcgaguucgaaucccgccagaucgaaguggacauagauggcaaaaagaagauaaaaacggucggaaaccgggucauaucgcgguccuccccacuauuccaggaguucaagauuuggcaaauccuaaacaacaucgagguaacagucgugggcaagaaacggaagagacgaaaacuaaaagaaaacuacagcgcauuauuugaggaacuaaacgacgccgaacaacucgaacucaacggcagcagacgacuaugucaagaagagaaagaacugcucgcccaggaacuguucguccgagauaagaugacaaaaagcgagguacuaaagcuacuguucgacaacccgcaagagcucgaccucaacuucaaaacaauagacggcaacaaaacuggauacgcccuguuccaggcauacucgaagaugauagaaauguccggacacgaacccguagacuucaagaaaccaguggaaaaaguggucgaguacauuaaagcagucuucgacuugcuaaacuggaacacugacaucuuaggauuuaacagcaacgaggaacucgacaaccaguccuacuacaaacuguggcaucugcuguacagcuucgaaggcgacaauacccccacggggaacgggcggcuaauacagaaaaugaccgaacuguacggguucgagaaggaguaugcaacaauacuagcaaacgucuccuuccaagacgacuacggcagccuguccgcgaaggccauacacaagauacuaccccaccuaaaggaggguaaccgauacgacguggcaugcgucuacgccggguaccggcacagcgaaucaucucuaacacgcgaagagauugccaacaaagugcugaaagaucggcuaaugcuccuacccaagaacagcuuacacaacccagucgucgagaaaauacucaaccagaugguaaacguaauuaacgucauaauagacauauacgggaaaccagacgaaauccggguagaacucgcccgggaacucaagaagaacgcaaaggagcgcgaagaguuaacaaaguccaucgcgcagacaaccaaagcacacgaagaguauaaaacacuccuacaaacggaauuuggauuaaccaacguaucccgcacggauauacugcgguacaaacuauacaaagaacuagaauccuguggauacaaaacgcuguacucaaacaccuacaucucacgugagaaacuuuucuccaaagaguucgauaucgagcacaucaucccccaagcccggcuguucgacgacuccuuuuccaauaaaacacucgaagcgcgaagcgucaacauagaaaaaggaaacaacaccgcguacgacuucgucaaggagaaauuuggagaaucaggcgccgacaacagucuggagcaauaccugaacaacauugaggaccucuucaagagcggcaaaauaaguaaaaccaaauauaacaaauugaagauggcugaacaagacauuccugacggcuucaucgagcgugacuugcgcaacacgcaauacauagcaaagaaagcguuaucaaugcucaaugaaaucagccaccgcguggucgccacaucagggucaguaacggacaaacugcgcgaagacuggcaacugauugacguaaugaaagaacucaacugggagaaauacaaagccuuaggccuagucgaguauuucgaagaccgagacgggcggcagauaggacgcauuaaagauuggacgaaacgcaacgaccaccggcaccacgcgauggacgcacugacugucgccuucaccaaggacguguucauccaauauuucaacaacaagaaugcaucgcuagacccaaacgccaacgagcacgcaauaaagaacaaauacuuccaaaacggccgggcaauagccccaaugccgcugcgagaauuuagggcagaagccaagaaacaccucgaaaacacacucaucuccaucaaagcaaagaacaaaguaauaacuggcaacaucaacaaaaccaggaagaaaggagggguaaacaaaaacaugcaacagacccccaggggccagcuacaccucgaaacaauuuacgggagcgguaaacaauaccuaacaaaagaagaaaaagugaacgcgagcuucgauaugagaaaaaucggcacaguaucaaaaagcgccuacagagacgcgcuccuaaaaaggcuguacgaaaaugacaacgacccaaagaaagcguucgcggggaaaaauagucucgacaaacagccgaucuggcucgauaaagagcaaaugcgaaaaguaccggagaaaguuaaaaucgucacgcuagaggcgaucuacaccauacggaaagaaauaagcccugaccuaaaagucgauaaagucaucgacgucggaguacggaaaauacucaucgaccggcuaaaugaguacggaaacgacgcgaagaaggcguucagcaaccuggacgagaaccccauauggcuaaacaaagaaaagggcaucucgaucaaacgagucaccaucucaggcaucagcaacgcgcaaucccuccaugugaaaaaggacaaagacggaaaaccaauccucgacgagaauggccgcaacauaccugucgacuucgugaauaccggaaacaaucaucaugucgcuguauacuaccgccccguaauagacaaaagaggacagcuagugguagacgaggcaggcaaccccaaauacgagcucgaagagguagucgugucauuuuucgaggcggucacucgagcuaaucuagggcaaccgauaauagauaaggacuauaagaccaccgaaggcuggcaauuccuauucuccaugaaacaaaaugaauacuucguauuccccaacgaaaagaccggcuucaauccaaaagaaauugaucuacuagacguagaaaacuacggacuaaucagcccgaaccuuuuccguguccaaaaguucucccugaaaaacuacguguuccggcaucaccuggagaccacaaucaaagacacuagcuccauccuccgagggauaacguggaucgacuucagaagcucgaaagggcuggacacaauagucaaagucagggucaaccauaucggccaaaucguaagcgucggcgaguacuga

SEQ ID NO: 6839 - RNA, 4311 nt, Artificial Sequence
  Cas9 variant
augaaaaggauacuagggcuagaccucggaacgaacaguaucggcugggcccucgugaaugaagcagagaacaaagacgaacgaagcaguauagucaaacuaggagucagagucaacccccugacgguagacgaguuaacgaacuucgaaaagggaaagagcauaaccaccaacgccgaccgcacauuaaaacgaggcaugagacggaaccuccaacgcuacaaacucaggcgagaaacccugaccgaaguccuaaaagaacauaaacucaucacggaagacaccauccuguccgaaaacgggaaccgcacaaccuucgaaacauauagacuccgcgcaaaagcggucaccgaggaaaucucgcuggaggaguucgcccggguccuccucaugauaaacaagaagcgaggcuauaaaagcucacggaaagcuaaaggagucgaagaaggaacauugauagacgguauggacauugcacgagaacuauacaacaacaaccugacaccaggagaacucugccuacaacugcuggaugccgggaagaaauucuugccagacuucuaccgaagcgaccuacaaaaugaacucgaccgcaucugggaaaaacaaaaggaguacuauccagagauauugacggacguacugaaggaggaacugcgaggcaagaagagagacgcggucugggccaucugugcaaaguauuuugucuggaaagaaaacuacacggaguggaacaaagagaaaggaaaaacggaacaacaggaacgggaacacaagcuagagggcaucuacucgaaacgaaagcgcgacgaagcgaaacgcgagaaccugcaauggcgcgugaaugggcucaaggaaaaacucagccucgaacaacugguaauaguuuuucaagaaaugaacacccaaauaaacaacucaagcggcuaccugggcgcgaucuccgaccgcaguaaggagcuauacuucaacaaacaaacgguagggcaauaccaaauggaaaugcuagacaaaaacccaaacgcaucacuccgcaacaugguauucuaccgccaggacuaccucgacgaguucaauaugcucugggaaaaacaggccguguaccacaaggaacucacggaggaacucaaaaaggaaauaagggacauaaucauuuucuaccagcggcgacucaaaagccaaaaagggcucaucgguuucugugaguucgaaucccgacaaaucgaggucgacauagaugggaagaagaaaaucaaaacgguggggaacagaguaauaucucguagcagcccacuguuccaggaguucaagaucuggcaaauccucaacaauauagaaguaaccguaguaggcaaaaagcgaaaacgcagaaaacucaaagagaauuacucugcccuguucgaggagcuaaacgacgcagagcaacuagaguugaacggaagccgccgguugugccaagaggagaaggaacuccucgcacaggaacuuuucauccgcgacaaaaugaccaaaagcgaagugcucaaacucuuguucgauaacccacaggagcucgaccucaacuucaaaacaauagacggaaacaaaacaggguacgcgcuguuucaggcguacagcaaaaugauagaaaugaguggccacgagcccgucgauuucaaaaagcccgucgagaaagucguagaauacaucaaagccguguucgaucuccucaacuggaacacggacauacugggcuuuaacucaaacgaagaacucgacaaccagccauacuacaaacuauggcaccuccuguacuccuucgaaggcgacaacacaccaacaggcaauggacgucucauccagaaaaugacagagcucuacggcuucgaaaaagaguacgcgaccauccucgcaaacgugagcuuccaagacgacuacggaucgcuauccgcgaaagccauccacaaaauucucccacacuuaaaggaagguaacagauacgaugucgcaugcguauacgccggcuaccgacacuccgaaucaucgcuaaccagagaggaaaucgccaacaaagugcucaaagaccggcuuaugcuccuaccgaagaacagccuacacaacccggugguggagaaaauacuaaaccaaauggucaacguaauaaacgucaucaucgacauauauggcaagccagacgaaauccgagucgaacuagcucgagaacugaagaagaacgcaaaggagcgugaagaacugacaaaaagcaucgcccaaaccaccaaagcacacgaagaauacaaaacccuauuacaaacugaguucggccucacaaauguaucccgcaccgauauccugcgcuacaagcuguauaaagaacucgaaagcugcggcuacaagacccuguauagcaauaccuauaucucaagggaaaagcuguucucaaaagaguucgacaucgagcacaucaucccccaagcacgacuuuuugacgacagcuucagcaacaagacacucgaagcccgcuccgucaacaucgagaaggggaauaaaaccgcguacgacuucguaaaggagaaauucggggagagcggugccgacaacagccuagagcacuaccucaacaacauagaggaccuuuucaaaucagggaagauaaguaaaacgaaguacaacaaguuaaaaauggcggaacaggauaucccagacggauucaucgagcgcgauuuacgaaacacgcaauauauagccaaaaaggcacuaagcaugcucaacgaaaucagccaccgcguaguagcgaccagcggaagugugacagauaaacuccgcgaagacuggcagcucaucgacgugaugaaagaacugaacugggaaaaauacaaggcccugggccuuguggaguacuucgaagaccgugacgggcggcaaaucgggagaauaaaagauuggaccaagcgaaaugaccaccgccaccacgcgauggacgcgcucacagucgccuuuacaaaggacgucuucauucaauauuucaacaacaagaacgcaagccuagacccaaacgcaaaugagcacgcaauaaagaacaaauacuuccaaaacggcagggccauugcccccaugccccuacgggaauuuagggccgaagccaagaaacaccuagagaauacccuaauaagcauaaaggcgaaaaacaaggucauuacaggaaauaucaacaaaacccgcaagaaaggcggcgugaacaagaacaugcaacaaaccccgcgaggacagcuccaccuggagaccauauacggcagcggaaagcaguaccugacgaaggaagaaaaagucaacgccagcuuugacaugagaaaaauagggaccguauccaaaagcgcauaccgagacgcccuauuaaaacgacucuacgaaaacgacaacgacccgaagaaggcguucgcagggaaaaacagccuagacaagcaaccaauauggcucgacaaagagcagaugcggaaagucccagaaaaagugaaaaucguuacccuagaggccaucuacacaauccgaaaagaaauaaguccugaccuuaaaguagacaaggugaucgacguaggcguccgcaagauccucauugaccgacugaacgaauacgggaacgacgccaagaaagcauucucgaaccucgauaaaaacccaauauggcugaacaaagagaaaggaaucagcauaaaaagaguaacaauaucaggcaucucgaacgcgcagucacuacacgucaagaaagauaaagacggaaaacccauacuugacgagaauggccggaauauacccgucgauuucgucaacaccggcaacaaccaucacguagcaguuuauuaccgcccggugauagacaaacgcggacaacugguagucgacgaagccggcaacccgaaauacgaacucgaagaaguagucguauccuucuucgaagcggugaccagagcgaaccugggccugccaauaaucgacaaagacuacaaaacaacagaaggcuggcaauuccucuucagcaugaagcagaacgaguacuuuguguuccccaaugaaaagacaggauucaaccccaaagaaauagaccuucuggacgucgaaaacuacggccucauaagcccgaaucucuuccgggugcaaaaguucagccugaaaaacuacguauuccggcaccaccuagagacgaccaucaaagauaccuccagcauacuaaggggcaucaccuggaucgauuucagaucuagcaaaggacuagauacgauagucaaagucagaguuaaccacaucgggcagauagucucggucggcgaauacuga

SEQ ID NO: 6840 - RNA, 4311 nt, Artificial Sequence
  Cas9 variant
augaaacgaauacuaggccucgaccuagguaccaacagcauugggugggccuuggugaacgaggccgaaaacaaagacgaacgaucaagcauaguaaagcugggcgucagagugaacccgcucacagucgacgagcucaccaacuucgaaaaaggaaaaagcaucaccaccaacgccgacagaacacuaaaaagaggcaugagacgaaaccuccaacgguacaaacuacggcgagaaacgcucacagaaguccuuaaagagcauaagcucaucaccgaggacacgauccuaucagagaacggaaauaggaccaccuuugaaacauaccgacuucgagccaaagccguaacugaggagaucucucuagaagaguucgcccggguacugcuuaugaucaacaaaaagcgaggauauaaaagcucccgcaaggcaaagggggucgaagaaggaacccugauagacggaauggacaucgcccgagaacucuacaacaacaaccuaacccccggggaacucugccuucagcugcucgacgcaggcaagaaguuccucccagacuucuaccgaagugaccuacagaacgaauuagacaggaucugggaaaaacaaaaggaauacuauccugaaauccucacggacguacuaaaggaagaacuccgcggcaagaaacgagacgcagugugggcgauaugugccaaauacuucgucuggaaagaaaacuacacagaauggaauaaggaaaaagguaaaacagaacaacaagaaagagaacacaaacuggagggaauauacuccaaaagaaagcgggacgaagcaaagcgcgagaaucuacaguggcgcgucaacggccuaaaagagaaacucucccucgagcagcucgucaucgucuuccaggaaaugaauacccagauaaacaacucgagcggcuaccuaggcgccauaucagaccgauccaaagaauuguacuucaauaagcaaaccgucggccaguaccagauggaaaugcuugacaaaaaccccaacgcaagccuacggaacauggucuucuaccggcaagacuaccucgacgaguucaauaugcucugggaaaaacaggccgucuaccacaaagagcuuaccgaagaauugaagaaagagauccgagacaucauuaucuucuaucaacgacgucugaagucacagaaaggucucaucggcuucugcgaguucgagucgcgacagaucgaggucgacaucgacggcaaaaagaaaauuaaaacagugggaaaccgcguuaucucccgaucaucaccccucuuucaggaguucaaaaucuggcaaauacugaacaacauagaagugaccguugucggaaagaaacguaaacgacgaaaacuuaaggaaaacuacagcgcgcuguucgaagaacuuaacgacgcagaacaacuagaacuaaacggcagccgaagacuuugccaggaagaaaaggaacuccuagcccaagaacucuucauccgagacaaaaugaccaaaagcgaaguacucaaacuccucuucgacaacccgcaggagcuagaccugaauuucaaaacaauagacgggaacaaaaccggcuacgcacucuuccaagcauacuccaaaaugauagaaaugagcggacacgaaccggucgauuucaaaaagcccguagagaaagucgucgaguauauaaaagccguauucgaccuacugaacuggaacacggauauccucggguucaacucgaacgaagaacuggacaaccaaagcuacuauaagcuauggcaucugcuauacuccuucgagggcgauaauacaccgacgggaaacggaaggcuaauacaaaagaugaccgagcuauacggcuucgagaaagaguacgccaccauccucgcgaacguauccuuucaagacgacuacggcucacucagcgccaaagccauccacaaaauccucccucaccucaaggagggcaaccgauacgacguggcauguguguacgcaggauaccggcacagcgagagcagccucacccgcgaagaaaucgcaaauaaagugcuaaaagaccgacugaugcuccuaccgaaaaacucgcuccacaacccaguagucgagaaaauacucaaccaaaugguaaacguaauuaacguuaucauagauauauauggcaagccagaugaaauccgagucgaacucgcgcgcgagcuuaagaaaaaugccaaagaacgagaggaauuaaccaagucuaucgcccagacaacaaaagcccacgaagaauacaagacacuccuacagaccgaguucggacuaacaaacgucagccgaacggacauccuucgcuacaaacucuauaaagagcuagagagcugcggcuacaaaacacucuacuccaacacauacaucucacgggagaaacuguuuucaaaagaguucgauaucgagcacaucaucccccaagcgcgacucuucgaugacagcuucagcaacaagacacucgaagcacgcagcgucaacaucgagaaagggaacaaaacagccuacgacuucgugaaggaaaaguucggggaaucaggcgccgacaacagccuagaacacuaccucaacaacaucgaagaccucuucaaguccggaaagaucagcaagacgaaguacaacaaacucaagauggcagagcaagacaucccagacggcuucaucgaacgcgaccuccgaaacacccaguauaucgcgaagaaagcgcucagcaugcuaaacgaaauaucgcaccgugucguugccacgagcggauccgugacggacaaacucagggaagacuggcaauuaaucgaugugaugaaagaacugaacugggaaaaauacaaggcacuagggcucguggaguacuucgaagaccgagacggccgccagaucggcagaauuaaagacuggaccaaacgcaacgaccaucgccaccacgcaauggacgcacucacggucgcuuuuaccaaagauguguucauacaauacuucaacaacaagaaugcaagccuagacccgaacgcaaacgaacacgcgaucaaaaacaaguacuuccagaacggucgagcaauagccccaaugccccuacgcgaguuccgcgccgaggccaagaagcaccuagaaaauacccucauaaguauaaaggcuaagaacaaagucauaacaggaaacauaaacaaaaccaggaagaaaggcggcgugaacaaaaauaugcagcaaacaccgagaggccaauuacaucucgagacaaucuacgggucgggcaagcaauacuugaccaaggaagagaaaguaaacgcuucauucgacaugagaaagauaggaacaguauccaaacuggcauaccgggacgcacuacucaaacgacucuacgagaacgacaaugacccaaagaaggccuucgcagggaaaaauagccucgacaaacagccaaucuggcuggacaaagaacagaugcgaaaaguaccagaaaaagucaaaauagugacacuggaagcgaucuacacaauacgaaaggagauaucccccgaccucaaggucgacaaaguaaucgauguaggaguaagaaaaauccucaucgaccgacucaaugaauacggcaaugacgccaagaaagcauuuuccaaccucgaugagaauccgaucuggcuaaacaaagagaaaggaaucagcaucaaacgcgugaccauaagcgguauauccaacgcccaaagccugcacgucaaaaaggacaaggacggaaaaccgauccucgacgaaaacggccgcaacaucccagucgacuuugugaacacuggcaacaaccaucacguagcagucuacuacagaccggugaucgacaagcgcggacagcuagucguagaugaagccgggaacccaaaauacgaacuagaggaagugguagucucauucuucgaagccguaacgagggcaaaccugggccaaccaauaauagacaaggacuauaaaaccaccgaaggauggcaauuccuauucagcaugaagcaaaacgaguacuuuguauuccccaacgagaaaaccggcuucaaccccaaagaaauagaccugcucgacguagaaaacuacggccucauuucccccaaccuguucaggguccagaaauucucacucaaaaacuauguuuucagacaccaccuagagacaaccauaaaggacacaagcuccauacuccgcggcauuaccuggaucgauuucaggucaucgaaaggccuugacacaaucgugaagguacgggugaaccacaucggacaaaucgucagcgucggagaguacuga

SEQ ID NO: 6841 - RNA, 4311 nt, Artificial Sequence
  Cas9 variant
augaagaggauucugggccucgaccugggaaccaauucuaucgggugggcucucguaaaugaagcggaaaacaaggacgaacgcucauccaucgucaagcucggagugagggucaacccccuaaccgucgacgaacugacgaacuucgaaaagggaaaaaguaucaccacgaacgcggaccgcacacugaaacgaggcaugcgccgcaaccugcagcgauacaaacuaaggcgcgaaacccuaacggagguccuaaaagaacacaaguuaauaaccgaggacaccauacuaucagaaaacgguaaccgaacuacauucgagacguauagauuacgagccaaagcggugacagaagagaucagccuggaagaguucgccagaguacugcugaugauaaacaagaaacggggcuacaagucaagccgcaaagcaaaaggcguagaagagggcacacugauugacgggauggacauagcaagagaacucuacaacaacaaccucacccccggagagcucugccuccagcuccucgacgcgggcaagaaauuccuccccgacuucuacagaagcgaucuucagaacgaacucgaccggauaugggagaagcaaaaggaguacuacccggagauccuaacagacguauuaaaagaggaacuacgcggcaagaaacgggacgccgugugggcgaucugcgcgaaauacuucguuuggaaagagacuuacacggaguggaauaaagagaaaggcaaaaccgagcagcaagagagagaacacaaacuugaaggcaucuacagcaagaggaagagagacgaggcaaaacgagaaaaccugcaauggcggguaaacggacugaaagaaaaacugucgcucgaacagcuaguuauaguauuccaagagaugaacacccaaaucaacaacagcucaggcuaccuaggcgcgauaagcgacaggagcaaagaacucuacuucaacaaacaaacggucggccaauaccagauggagaugcuugacaagaacccaaaugcgagucugcgcaacauggucuucuacagacaagauuaccuagacgaguucaacaugcugugggaaaaacaagcagucuaccacaaggaacuaacugaagaacuaaagaaggaaauccgagacauaauuaucuucuaucaaaggcggcugaaaagccaaaaggguuuaaucggauucugcgaauuugagucucgucaaaucgaagucgacaucgacggaaagaaaaagauaaagacggucggcaaccgcguuauaucccgaucaagcccacuguuccaggaguucaaaauauggcaaauacucaacaauaucgaagucacaguagugggcaagaagagaaagagaagaaaacuaaaagaaaacuacagcgcaauuuucgaggagcucaacgacgcggaacaacucgagcugaacggaucacgaaggcucugccaggaggagaaggaacugcucgcgcaagaacucuucguacgcgacaaaaugacgaaaagcgaaguacucaaacuccuauucgacaacccccaagaacuagaccuuaacuucaaaacaauugacgggaacaagacaggguacgcgcuguuucaagcauacuccaaaaugauagaaaugucaggccacgaacccgucgacuucaaaaagccaguugagaaaguugucgaguacaucaaagcagucuucgaccuucuaaauuggaacacagacauccuaggguucaacuccaacgaagaauuagacaaccaaagcuacuacaaacucuggcaccuccucuacuccuuugagggcgacaacacgcccacaggcaacggcagauugauacagaaaaugacagaguuauacggcuucgaaaaggaauacgccaccaucuuggcaaacgugagcuuucaagacgacuacgggucccucagcgcaaaggccauccacaaaauccuaccccacuuaaaggaaggaaacagauacgacguggcgugcguauaugccggauaccggcacucagaauccagccuaaccagggaagagaucgcaaacaagguccucaaggacagacucaugcuacuccccaaaaacagccuacacaauccagucguagagaaaauacugaaccagauggugaacgucaucaacgucauaauagacauuuacggcaagccggacgaaauccgagucgaacuggcccgcgagcuaaagaagaacgccaaagaaagagaggaacuaaccaaaagcaucgcgcagaccacaaaagcaaacgaggaguacaaaacccuccuccaaaccgaguucgggcucacaaacgucucccgcacugacauacuacgcuacaagcucuauaaggaguuagaaagcugcggcuacaaaacgcuuuacagcaauaccuacaucucgcgggagaaacucuucucgaaagaguucgacaucgaacacaucauaccacaagcccgccuguuugacgauagcuucucaaacaaaacucuggaagcccggucagugaacaucgaaaaagggaauaagacagccuacgacuucgucaaagaaaaguucggggagagcggcgcggacaauucgcuugagcacuaucuaaacaacauugaagaccucuucaaaucagggaagauaagcaaaacuaaguacaacaaacucaaaauggcuaaacaagacauucccgacggcuucauagaacgcgaccugcggaacacccaauacauagccaagaaagcccuuagcaugcucaacgaaaucucccaucgcgucgucgcgaccucggggagcguaaccgauaaacuccgagaagauuggcaacucaucgauguuaugaaagaacucaacugggaaaaauacaaagcguuggggcuaguagaguacuucgaagacagagacggacggcaaaucggacggauaaaagauuggacuaagcgaaacgaccaucgacaucaugcaauggacgcccugacuguagccuuuaccaaagacgucuucauacaauacuucaacaacaagaacgcaucacucgacccgaacgcgaacgaacacgcuaucaagaacaaauacuuccaaaacggacgggccauagccccgaugccauuaagagaguuccgcgcugaagcuaagaaacaccuagaaaacacacuaauaucuaucaaagcuaaaaacaaggugaucacagggaacaucaauaagacgcggaagaaaggcggaguaaauaaaaacaugcagcagacgccacggggccaacugcaccuagaaacgaucuacggaucagggaaacaguaccucacaaaagaagaacgcgucaacgccagcuucgacaugagaaagauagaaaccgugucgaaauccgccuaccgagaugcccugcuaaaacgccuguacgaaaacgacaacgacccgaaaaaggccuucgcaggcaaaaauucacucgacaagcaaccaaucuggcuagacaaggaacagaagcggaaaguaccggaaaaagucaagauuguaacccucgaagccauauacacgauucggaaggaaauaagucccgaccucaaaguagacaagguuauagacguuggcguaagaaagauccuaaucgacaggcugaaugaauacggcaacgacgcgaagaaagcauucuccaaccucgacgagaacccgauuuggcugaacaaagaaaaagggauaaguaucaagcgcgucacaauaagcggaaucucaaacgcccaaucucuccacgugaagaaagacaaagacggcaagccaauucuagacgaaaacggaagaaacauuccgguagacuuugucaacaccggaaauaaccaccacgucgcggucuacuaccgccccgugauagacaagcgagggcaauugguaguagacgaagcagggaaccccaaauacgaacucgaagagguagucgucagcuuuuucgaagcagucacccgggccaaccucgggcagccgaucauagacaaagacuacaaaaccacggaaggcuggcaguuucucuucagcaugaaacaaaaugaguacuucguauucccaaacgagaaaaccggguucaaccccaaggaaaucgaccuacuugacguggaaaauuacggccuaaucucaccgaaucuauuccggguacaaaaauucucucucaaaaacuacguuuuccgccaccaccuagaaacaaccauaaaagacaccuccucaauccuacgagggaucaccuggauagacuucagaagcagcaaagggcuagacaccaucguaaaagugagaguaaaccacaucggccagaucguuucagucggcgaauacuga

SEQ ID NO: 6842 - RNA, 4311 nt, Artificial Sequence
  Cas9 variant
augaaacgaauccucggacuagaccucggcacaaacuccauaggcugggcccucgucaaugaggcagagaacaaggacgagcguagcuccaucguaaagcucggugucagaguuaacccucuaaccgucgacgaacuaacgaacuuugaaaagggcaagagcauaacaaccaacgcugaccggacgcuuaagcggggcaugcgccgaaaccuccagagauacaaacugcggcgcgagacacucaccgagguccuuaaggaacacaaacuuaucacagaagacacaauccuaucagaaaacgggaacaggacgacguucgaaaccuaccggcuccgcgcaaaggcugucacggaagagauaagccuugaagaguuugcuaggguacuucuuaugaucaacaagaaacgcggcuacaagagcucgcgcaaagcaaagggagucgaagaaggaacgcuaaucgacggcauggacaucgcgcgcgagcuguauaauaacaaccucacgcccggagagcucugccuacaacuacucgaugcaggcaagaaauuccugccggacuucuaccgcagcgaccuacagaacgaacuagaccgcauuugggagaaacaaaaagaauacuaucccgagauccucaccgacguauugaaagaagaacuacgagggaagaaacgagacgccguaugggccaucugcgcgaaguacuuugucuggaaggaaaccuacacggaauggaacaaagaaaaagggaaaaccgagcagcaggagaaagaacacaaacucgaaggcaucuacagcaagaggaaacgggacgaagcaaaacgcgagaaccuacaauggcgagugaacggacugaaggaaaaacuaucacuggagcagcuaguaauaguguuccaagaaaugaacacacagaucaacaacagcagcggcuaucuaggagcaaucagcgacagguccaaagagcucuacuucaauaagcagacaguaggccaauaccagauggaaaugcuugauaaaaauccgaacgcgucccuccgcaacaugguauuuuaccgacaggacuaucuggacgaguucaauaugcugugggaaaaacaagcgguguaucacaaagaacucacugaagaauuaaagaaagagauacgcgacaucaucauauucuaccaacgacggcuaaagagucagaagggccucauuggguucugugaauuugagucgagacaaaucgagguagauauagacggcaaaaagaaaaucaaaaccgucgguaaccgcgugauaucccgaucaagcccucucuuccaagaguucaagaucuggcaaauacucaacaacauagaagugacaguggugggaaagaaaagaaaaaggcgcaaauuaaaagagaacuacagcgcacuauuugaggaacucaaugacgcagaacagcucgagcucaacggcagucggcgccugugccaagaagaaaaggaauuauuagcccaagaguuauucaucagagacaagaugaccaaaagugaaguucuaaaacugcuguucgacaacccccaggaacuagaucugaacuucaagaccauagacgggaacaaaacuggauacgcacucuuccaagcguacucgaagaugaucgagaugaguggacacgagccggucgacuuuaaaaagccggucgaaaaggucgucgaauacauaaaagcgguguucgaccuacuuaacuggaacacagacauacucggauucaacucaaacgaagaacuagacaaccaaucguauuacaaacucuggcaccuucucuauagcuucgagggagacaacaccccaaccggaaacggucgacugauccagaagaugaccgagcuauacggguucgagaaggaauacgcaacaauauuagccaacgucagcuuccaggacgacuacggaucgcucagcgcaaaggcaauccacaaaauccucccccaccucaaagaaggcaacagguacgacguagccugcguguacgccggcuaccgccacuccgaaaguucccuaacgcgcgaggagaucgccaacaaaguacuaaaagaccggcuuaugcuccuccccaagaacucacuccauaacccugucgucgaaaagauauuaaaccagaugguuaacguaaucaacgugauaaucgacaucuacggcaagccugacgaaauaagagucgaacuagcccgagagcuaaagaaaaacgccaaagaacgagaggagcuaacuaaauccauagcacaaacaaccaaggcacacgaagaauauaaaacacuccuccaaacggaguucggccugacuaacgucucacguaccgacauacucagguacaaguuguacaaagaacucgaaucaugcggcuauaaaacgcuauacucaaauacguacauaagucgagagaaacuuuuuagcaaagaguucgacauagaacacaucauaccgcaagcccgacuauucgaugacagcuuuuccaacaaaacccucgaagcgcgaagcgucaacaucgagaaaggaaacaagacggcauacgacuucgucaaagaaaaguucggcgaaaguggcgccgacaacagccuagagcacuaccucaacaacauugaggaucuauucaaaucgggcaaaaucagcaagacaaaauacaacaagcucaaaauggccgaacaagauauaccagacggguucauagagcgagaccuacgcaacacgcaguauaucgcgaagaaagcccuaagcaugcuaaacgaaaucagucaccgcgucguagccaccuccggaucagucacagacaaacuccgcgaggauuggcagcuuauagacgugaugaaagaacugaacugggaaaaauacaaggcgcucggccuaguagaguacuucgaggaccgcgacggcaggcaaaucggccggauaaaggacuggaccaaacgcaacgaccacagacaucacgcaauggacgcacucacgguugcuuucacaaaggacguauucauacaauacuucaacaacaaaaacgccagccucgacccaaacgcaaacgaacaugccaucaagaacaaguauuuccaaaacggucgcgcuauugcgcccaugccacugcgagaguucagggcagaagcaaagaaacaucuagagaacacgcucauuucgaucaaagcgaaaaauaaagucaucacgggcaacauaaacaagacgcguaagaaagggggagucaacaaaaacaugcagcaaacuccccgaggccaacugcaccuagaaaccaucuacggcuccggcaaacaauaccucaccaaggaagagaaagugaaugcguccuucgacaugcggaaaaucgggacugugaguaaacucgcguaucgcgacgcccuuuugaaacgccucuacgaaaacgacaacgaccccaaaaaggcauucgcgggcaaaaacucacuagacaaacaaccgauauggcuagauaaagagcaaaugagaaagguuccagaaaaagucaaaaucgugacccucgaagcaauauacacgauccgcaaggaaaucuccccagacuuaaaagucgacaaaguaauagacguagguguccgaaagauccuaauagaccgccucaacgaauacggaaacgaugccaagaaagcguucagcaaccuagacgagaaccccaucuggcugaauaaagaaaaagggaucucaauaaaacgagucacuauaagcgggaucucaaacgcucagagucuccacgucaagaaagacaaagacggcaaacccaucuuagacgaaaauggccgcaacaucccaguagacuucguaaacacaggaaacaaccaccacgucgcuguauacuacagaccgguaaucgacaaacggggacagcuaguuguagacgaagcuggcaaccccaaauacgaacuagaagaaguagugguaaguuucuucgaagccguaacaagggcaaaucucggccaaccaaucaucgacaaagacuacaaaacaaccgaaggguggcaauuucuauucuccaugaagcagaacgaauacuucgucuuccccaacgagaaaaccggcuucaauccaaaagagauagaucuccucgacguagagaacuacggauuaauaagccccaaccucuuccggguccagaaauucagccucaaaaacuaugucuuccgccaccaucucgaaacaaccaucaaagacaccaguagcauacuccggggcauaaccuggaucgacuucaggagcagcaaagggcuugacacaauugugaaggucagggucaaucacauuggucaaauagugucagucggggaguacuga

SEQ ID NO: 6843 - RNA, 4311 nt, Artificial Sequence
  Cas9 variant
augaagcgcauacuaggccucgaccuagguacgaacaguaucggaugggcccuagucaaugaagccgagaacaaggacgagcgcagcaguauaguuaaacuaggcguccgcgucaacccccugacagucgacgaacucaccaacuucgagaaggguaaaaguaucacgaccaacgcggauaggacacuaaagagaggcaugagaaggaaccuacaacgcuacaaacugcgccgggaaacccucacugaaguacuaaaggagcacaagcuaauuacagaggacacaauacuaucagagaauggaaaccgcaccaccuucgaaaccuaccgccugagagccaaagcggucacagaagaaauaucacuagaggaguucgcaagaguacuucuaaugauuaacaagaaacguggcuacaaaucaucgagaaaggccaagggcguggaagaaggaacacucauagacggcauggacauagcgagagaacuguacaacaacaaccugacccccggcgagcuaugccuacaacucuuagacgcgggcaagaaguuucuacccgacuucuaccgcagugaucuccaaaaugagcuggaccgcaucugggagaaacaaaaagaauacuacccggaaauacuaaccgacguccucaaagaggagcugcgaggaaagaagcgcgacgccguaugggccaucugcgccaaguacuuugucuggaaagaaaacuacacugaguggaacaaagagaaagguaagaccgaacaacaagaacgagagcauaaacucgaaggcauauacucaaaacgcaaacgugaugaagcaaagcgcgagaaucuucaguggagagugaauggacuaaaagaaaaacucucccucgaacagcuagucauugucuuccaagaaaugaacacgcaaaucaacaacaguagcggguaccucggagcaaucuccgaccgauccaaggaacucuacuucaacaaacaaacgguaggccaauaccagauggaaaugcuagacaaaaacccuaaugcaucgcugaggaacaugguuuucuacaggcaggacuaccuagacgaguucaacaugcugugggagaaacaggcggucuaccacaaggaguugaccgaagaacugaagaaagaaauacgagacauaaucauauucuaccaaagaaggcugaaaucacaaaaaggcuuaauaggcuucugcgaguucgaaucgcggcaaauagaagucgacaucgacggcaaaaagaaaauuaaaacagucgggaaccgcguaauuucaagaucaucgccgcuauuccaagaguucaaaaucuggcagauccucaauaacaucgaagucacgguagucggcaagaaaagaaaacgcagaaaacugaaggagaacuacagcgcacucuucgaagaacucaacgacgcggaacagcuagagcucaacggcucaagacgguuaugccaagaagaaaaggaacugcucgcucaagaacucuuuauacgagacaaaaugacgaaaucagaagugcuaaaacuccucuucgacaacccacaggaacuugaccuuaacuucaaaacaaucgacggcaacaagaccgguuaugcgcuauuccaagccuacagcaagaugaucgagauguccggccacgagcccgucgacuucaagaaacccgucgagaaagucgucgaauacauaaaagccguguucgaccuacuaaacuggaacacugacauccucggcuucaacaguaacgaggagcuagacaaucaacccuacuacaaacuuuggcaccuccucuacucauucgaaggcgacaacacacccaccggaaacggucgucugauccagaaaaugacagaacuauacggauucgaaaaggaauacgcaacaauccuagccaacguuuccuuccaagacgacuacggcagccuaagcgcaaaagccauacauaaaauacugccacaccucaaggaaggaaaccgauacgacgucgccugcguauacgcaggcuaccgccacuccgagagcucccucacccgcgaagaaauagcaaauaaaguccucaaagacagacuaaugcuccugccaaagaacagucuccauaacccggucguggagaaaauccuaaaccaaauggucaacgucauaaacgucaucauagacaucuaugggaaaccagacgaaauacgcguggaauuagccagagaacucaagaaaaaugccaaagaacgcgaggaacuuacaaaaagcauagcacaaacaacgaaagcccacgaagaauacaaaacccuucugcaaacagaguucggccucaccaacgucucaagaacugacauccuacgcuacaagcuauacaaagaacuugaaagcuguggauacaagacacucuacagcaacaccuacaucucucgagaaaaacuauucucgaaagaguucgacaucgaacacauuauaccgcaagcgcgccuguucgaugacagcuucucaaauaaaaccuuagaagcgcguagcgugaacauagagaagggaaacaaaaccgccuacgacuucguuaaagaaaaauucggcgaaucaggcgccgacaacucccuagaacacuaccuuaacaauauagaagaccucuucaaaucagggaagaucucgaagacaaaguacaacaagcuaaagauggcggaacaagacaucccggacggguucaucgaacgcgaccuaagaaacacacaauacauagccaaaaaggcacucagcaugcucaacgaaaucagucaccgagucgucgcaaccucaggaagcgucaccgauaaguuacgggaagauuggcagcuaaucgacgugaugaaggaacuaaacugggagaaauacaaagcccucgggcucguggaguacuucgaggaccgcgauggccgacagaucggacgcaucaaggacuggaccaaacgcaacgaccauagacaccacgcaauggacgcccucaccgucgcguucacgaaagacguauucauccaauacuucaacaacaaaaacgccucccuagaccccaacgcgaacgagcaugccaucaaaaacaaguacuuccagaacggcagagcaauagcucccaugccucugcgggaguuucgcgcugaagcaaagaaacacuuagaaaacacccucaucagcaucaaagcuaaaaacaagguaaucacgggaaacaucaacaaaacccgaaagaaaggaggaguuaacaaaaauaugcaacaaacgccuagaggacaacugcaccuggaaacaauauacggaagugguaaacaauaccugaccaaagaagagaaggucaacgcgagcuucgacaugaggaagauugggacaguaaguaaaagugccuacagggacgcccuccucaaacgccuauacgaaaacgacaacgacccgaagaaagccuucgccggaaagaacucacucgauaaacaacccaucuggcucgacaaggaacaaaugagaaaaguaccagaaaaaguuaaaaucgucacccuugaagcgaucuacacaauccgcaaagagauauccagcgaccugaaggucgacaaggugaucgacguaggcgugcggaagauauugaucgaucgcuuaaacgaguacgggaacgacgcaaagaaagcguucucgaaccucgacaagaacccgaucuggcucaacaaagagaaagguauaucaauuaaacgagugacuaucucaggcauuucaaacgcacagagccuccacgucaagaaagacaaagacggaaagccuauccuugacgaaaauggccgaaacauuccagucgacuuugucaacacgggaaauaaccaucacgucgcgguguacuacagacccguaaucgacaagcggggacagcucgucgucgacgaggccggcaauccaaaguacgaacuggaggagguaguggugagcuucuucgaggcaguaaccagagcaaaccuagggcugccaaucaucgacaaggacuacaaaaccaccgaaggcuggcaauuccuauucuccaugaaacagaacgaauacuucguauuccccaacgagaaaaccggauucaaccccaaagagauugaccuccucgacgucgaaaacuacggccucaucagcccuaacuuauucagggugcagaaguucagccuaaagaacuacgucuuccgacaccaccucgagacgacgaucaaggacacuagcuccauccuccgcggcauuacguggaucgacuuccgcagcucaaaaggacuugacacaaucguaaaggucagaguaaaccacauaggccaaauagucaguguaggagaguauuga

SEQ ID NO: 6844 - RNA, 4311 nt, Artificial Sequence
  Cas9 variant
augaagagaauccucggccuggaccuaggcacaaacucgaucggaugggcgcuagucaaugaggccgagaacaaagacgagcgcuccuccaucgugaaacucggcguacgagucaacccccucacaguagacgagcuaacuaacuucgagaaagggaaguccauaaccacgaacgccgaccgaacucuaaagagaggaaugcggcggaaucuccaaagguacaaacuucggcgggaaacgcucacagagguacuaaaggaacacaagcugaucacagaggauaccauccucagcgaaaacgggaacagaacaaccuucgagacauaccgucucagagccaaagccgugacugaagaaaucagccucgaagaguuugcacgaguacuacugaugauuaacaagaaacgaggauacaaguccucacgcaaagccaaaggcguagaggaaggcacccuuauagacggaauggacaucgcccgggagcuuuacaacaauaaucucacgccgggggagcuaugccuacaacuacuugacgccggcaaaaaguuucuccccgacuucuaccgaucggaccugcaaaaugaacucgaccggauuugggaaaagcagaaggaguacuauccagaaauacugaccgacguccuaaaagaggaacugcgaggaaagaaacgcgacgcugucugggccauaugcgccaaauacuucguguggaaggagaacuacaccgaauggaacaaagaaaaaggcaaaacggagcaacaagaacgagaacacaaacuggaggguaucuacuccaaaagaaaacgggacgaagccaaacgcgagaacuuacaauggagagucaauggccucaaagaaaagcuauccuuggaacagcucgucauaguauuucaagaaaugaacacccaaaucaacaacaguuccggauaccucggcgccauauccgacagaucaaaggagcuguacuucaauaaacaaacagugggccagugccagauggaaaugcucgacaaaaacccaaacgccagccucagaaacauggucuucuaccggcaagauuaccuugacgaauuuaauaugcucugggaaaagcaagcgguauaccacaaagaacucacagaagaacuaaagaaagagauccgagacaucaucauauucuaucaacggcgacucaagagccaaaaaggucuaaucggcuucugugaauuugaaucacgacagauagaaguagacaucgacggcaagaaaaagaucaagacgguugggaacagggugaucucgagaagcagcccgcuauuccaagaguucaagauauggcaaauccucaacaauauagagguaacagucguuggaaagaaacggaagcgcaggaagcuaaaagagaacuacucugcccuguucgaagaacuuaacgacgcagaacaacuggagcuuaacggcucacguagacucugccaagaggaaaaggaacuccucgcacaagagcuguucauacgagacaaaaugacgaaauccgaaguccugaagcuacucuucgacaacccccaagagcuagaccugaacuucaagacaauagacggaaacaagaccggauacgcucucuuccaagccuauuccaagaugaucgaaaugagcggacacgaaccagucgacuucaagaaaccggucgagaaaguagucgaguacauaaaagccguauucgaucuccugaauuggaacacggacauccucggcuucaacucgaacgaggaacuagacaaccaaccuuacuacaaauuauggcaucugcuguacucauucgaaggagacaacacgcccacagggaacggaaggcuaauccagaaaaugacugagcuguacgguuucgaaaaagaauacgcaaccauacuggcaaacguauccuuccaagacgacuacgguagucucagcgcaaaggccauacacaagauccuaccgcaccuaaaagagggcaaccgauacgauguagccugcguguacgccggcuaccggcacuccgaaucaucucuuacccgggaagaaaucgcuaacaaagugcuaaaagacaggcugaugcuccuaccgaaaaacucgcuccacaacccgguagucgaaaagaucuuaaaucaaauggucaacguuauaaacguaaucauagacaucuacggcaagccagaugaaauccgaguagaacuggcacgagagcucaagaaaaaugccaaagagcgcgaagaauuaacgaaguccauagcacagacaacgaaggcccacgaggaauauaagacacuccugcaaacagaguucggccucaccaacgucagcagaaccgacauccuacgguacaaauuauauaaagaacucgaaagcugcggcuacaaaacgcucuacucgaacacauacauaucaagagagaaacuguucucaaaagaguuugacauagagcacauaaucccccaggcacgccucuucgacgacucuuucucaaacaaaacccuagaagcacgcagcgugaacaucgaaaaagggaacaaaacagcauacgacuucguaaaagagaaauucggggaaucuggcgccgacaacucccuagaacacuaccugaauaacauugaggacuuguucaaaagcgggaaaauaagcaaaaccaaguacaacaaacuuaaaauggccgaacaagacauacccgacggcuucaucgaacgcgaucugcggaacacucaauacauagccaagaaagcacucagcaugcucaacgagauaagucaccgcguaguagcgaccuccggcagcguaacagacaagcuccgcgaggacuggcagcugaucgacgucaugaaagaacugaauugggagaaguacaaagccuuaggccugguagaguacuucgaagaccgagacgggcgucaaauaggacgaaucaaggacuggacaaagcgcaacgaccacagacaccacgcgauggacgcccugaccguagcguucaccaaggacgucuucauacaguacuuuaacaauaaaaacgcuagcuuggacccgaacgcgaacgagcacgcgauaaagaacaaauacuuccaaaaugggcgcgcaaucgcaccgaugccacuccgagaguuccgcgcggaagcaaagaaacaccuugagaauacccuaaucucgaucaaggccaaaaacaagguaauaaccgguaacauaaacaaaacccgcaagaaaggcggcguaaacaaaaacaugcagcaaacucccagaggccaacuccaccucgaaacgauauacggcagcggaaaacaauacuugacgaaggaagaaaaggucaacgccagcuucgacaugcgaaagauaggaacagugagcaaaagcgccuaccgagacgcacuucugaagaggcuuuacgagaacgacaacgacccgaaaaaggcguucgcaggaaagaacucucuggacaagcagccaauauggcucgacaaagaacaaaugagaaagguaccggaaaaagucaaaaucgucacauuagaagcgaucuacacaauccgaaaagagauaagcccggaccuaaaaguagauaaggucauagacgucggcguccgcaagauccucaucgaccgccucaacgaauauggcaacgacgccaagaaagcauucucaaaccuagacaaaaacccgaucuggcucaacaaagagaaaggaauauccaucaagagagugacgaucagcggaauaagcaacgcccaauccuuacacgugaaaaaggacaaagacgggaagccgauucucgacgaaaacggaagaaacauccccguagacuucguuaacaccggaaacaaucaucacgucgcgguauacuaccgaccugucauagacaaacggggacaacuggucguagacgaagccgggaacccaaaauacgagcucgaagaaguuguagucucguuuuucgaagcugugacacgggcaaaccuggggcuacccauaaucgacaaagacuacaagacaacggaaggguggcaguucuuguucagcaugaaacagaacgaguacuucgucuuucccaacgagaagacaggauucaauccaaaagagaucgaccuacucgacguggaaaacuacggccucaucuccccuaaccuguucagagugcaaaaauucucacucaaaaacuacguauuccgccaccaucuagaaaccaccauaaaagauaccagcuccauccugaggggcaucacuuggaucgacuucaggagcagcaagggccuagacaccauagugaagguacggguaaaccacaucggacagauugucagcgucggcgaguacuga

SEQ ID NO: 6845 - RNA, 4311 nt, Artificial Sequence
  Cas9 variant
augaaacggauccucggacuggaucuaggcacaaauucgauuggcugggcauuagucaacgaggcggaaaacaaggacgagcgaagcaguauuguaaaguuaggcguacgcgucaacccccucaccguggacgaacugacaaacuuugagaagggaaagucaauaacaaccaacgcagaccguacccuaaagcgaggcaugcgccgcaaccuccaaagguacaaacucagacgcgagacacugacagaaguacugaaggagcacaaacuaauuaccgaagacaccauccucucagagaacggaaaccgcaccacauucgaaaccuaccgccuacgcgcgaaagcggucacggaggaaaucucacucgaggaguucgcaaggguacuccucaugaucaacaaaaagcgagguuacaaauccaguaggaaagccaagggaguugaagaaggcacccuaaucgacgggauggacaucgcacgcgagcucuacaacaacaaccucacgccaggagaacucugccuacagcugcuggacgcagguaagaaauuccuccccgacuucuaccggucugaccuccaaaaugagcucgacagaaucugggaaaaacaaaaggaauauuacccggaaauucugaccgacgugcugaaagaggaacuccggggcaagaagagagaugcagugugggccauaugcgcaaaauacuucguauggaaggagaccuacacagaguggaacaaagaaaagggcaagacugagcagcaggaaagggaacacaaacuagaggguauuuacagcaagagaaagagagacgaggccaagcgugaaaaccuucaauggagaguaaacggcuugaaggagaagcucucacuagaacaacucgugaucgucuuccaggaaaugaacacccaaaucaacaacucaagcggguaccuaggcgcaaucuccgaccgaagcaaagaacuguauuucaacaaacaaacgguaggccaguaucagauggagaugcuagacaaaaacccgaacgccagucuccgaaacaugguauucuaccgccaagacuacuuagacgaguucaacaugcucugggaaaaacaagcagucuaucacaaggaacuuaccgaagaacucaagaaagagauccgagacaucauaaucuucuaccagcgcagacucaaaagccagaaaggccucauuggauucugcgaguucgaaucacgccagaucgaaguagauaucgaugggaaaaagaagauaaagacggugggaaaccgaguuaucagccgaucaagcccccucuuucaagaguucaagaucuggcagauauuaaacaacaucgaagucaccgucgucggcaaaaagcgaaagcgacggaaacuuaaggaaaacuacucagcaaucuucgaagaacuaaacgacgcggagcaacucgagcugaacggcuccagacgacugugccaagaagaaaaagaacuccucgcccaagaacucuucgucagagacaagaugaccaaauccgaaguacuaaagcuguuguucgacaacccgcaggagcuugaccucaacuucaaaacaaucgacggcaacaagaccggcuacgcccucuuccaggccuacucgaagaugauagaaauguccggccacgagccugucgacuucaagaaaccgguagaaaaaguagucgaauauaucaaagcaguguucgaucuccucaacuggaauacagacauccugggguucaauuccaacgaggaacucgauaaucagucguauuacaaacuguggcaucuauuauacagcuucgaaggcgacaacacgccaacagggaacgggaggcugauacagaaaaugacagaacucuacggauucgagaaagaauacgcaaccauacuagcaaacguuagcuuccaagacgacuauggcucgcuaagugcaaaagccauccacaaaauccuaccccaccuaaaagaggggaacagauacgacguagccugcgucuacgcgggcuaucgacacucggaaagcagccucacgcgagaagagauagccaacaaaguacuaaaagaccgacuaaugcuucucccgaaaaacaguuugcacaacccagucguagagaaaauacucaaccagauggugaacgucaucaacgucaucauagacaucuacgggaagcccgacgaaauacgcguagagcuugcgagggaacucaaaaagaacgcgaaagagagggaggaacucaccaagucgauagcccagacaaccaaagccaacgaagaauacaaaacccuucuacaaaccgaguucgggcugaccaacgugucaagaacagacauacuucgcuacaaacuauacaaggaacuagaaagcugcggcuacaagacccucuacucgaacacauauaucagccgcgaaaagcuauucagcaaggaguucgacauagaacacaucaucccacaagcacgacuguucgacgacaguuucagcaacaaaacccucgaagccagaagcgucaacaucgaaaaggguaacaaaaccgccuaugacuucgucaaggaaaaauucggcgaauccggcgccgacaauucgcucgaacacuaucucaauaauaucgaagaccuauucaagucgggaaaaauaagcaaaacaaaguauaacaaacuaaaaauggcggaacaagacauacccgauggcuucauagaaagagaccugcgcaacacccaauacaucgcaaagaaagcacugaguaugcugaacgagaucucacacaggguggucgcaaccuccggcagcguaaccgacaaacuacgcgaggacuggcagcuuauagacgucaugaaagagcuaaauugggaaaaauacaaagcccugggauuagucgaguacuucgaagaccgggauggccgccaaaucggacgaauaaaagacuggaccaagcggaacgaccauagacaccacgcgauggacgcccuuaccguagccuucacuaaggacguguucauccaguacuucaacaauaaaaaugccucccuagaccccaacgcuaacgaacacgcgaucaaaaauaaauacuuccaaaacgggagggcaauagcccccaugccccuccgugaguuccgcgccgaagccaagaaacacuuagagaacacccugaucuccauaaaagccaagaauaaagucaucacgggcaauaucaacaaaacacgcaagaaaggaggggucaacaagaacaugcaacagacgccacgaggccaacuacaucuggaaacaaucuacggauccgggaaacaauaccugacaaaagaggaaaaagucaaugccucauucgacaugaggaaaaucgaaaccgucuccaaaucagccuacagagacgcccuucucaagcgacuuuaugagaacgacaacgaccccaaaaaggcauucgcgggcaaaaacucccucgacaaacaacccaucuggcucgauaaagaacaaaugaggaaagucccggaaaaaguaaaaauagucacccucgaagccauauacacaauccggaaagagauaucaccggaccugaaaguagacaaaguaauagacgugggggucaggaagauacucauugaccgccugaacgaauacggaaacgaugccaagaaagcauucucgaaccuugacaagaacccaaucuggcucaacaaagaaaaaggcauuucgaucaagcgaguaaccauauccgggaucuccaacgcccagucccuacaugugaaaaaggacaaggacggaaagccuaucuuagaugaaaacgggaggaacauacccguggacuucguaaacacagggaacaaccaccacgucgccguguauuaccgcccagucauagacaaacgcggacaacucguagucgacgaagcaggcaacccaaaguacgaacuugaagaggucgucgucucguucuucgaagcagugacaagagcaaaccucggacuaccaauaaucgauaaagacuacaaaacuacagagggcuggcaguuccucuucagcaugaaacagaacgaguauuucgucuuccccaacgagaagaucggcuucaacccaaaagagaucgaccugcuagacgucgaaaacuacggccuaauauccccuaaucuauuccgaguacaaaaauucucacucaagaacuacguauuccgccaccaucuugaaacuacaauaaaagacacuuccucaauacucagaggcaucacguggaucgacuuccgcagcagcaaaggacuggacacaaucgucaaggucagggucaaccacaucggacagauagucagcguaggagaauauuga

SEQ ID NO: 6846 - RNA, 4311 nt, Artificial Sequence
  Cas9 variant
augaaaagaauccucgggcuggaccuaggcacaaacagcaucggaugggcacugguagaugaagccgaaaacaaagacgaacgaaguucgaucgucaagcucggagugagggugaacccacugaccgucgacgaacucaccaacuucgaaaagggaaagagcaucacaacaaacgcggauagaacccucaaacgaggaaugcgccgaaaccuacaacgcuacaaacucagaagagagaccuuaauggaaguucucaaagagcacaagcuaaucacagaagauacaauccuaagcgaaaacgggaaccgaacaacguucgagaccuaccgacuacgagcaaaagcagcaaccgagaaaaucucgcuggaagaguucgcacggguccuucucaugauaaacaaaaagagggguuauaaauccugccguaaagccaaaggcgccgaagaagguacccuaauagacgggauggauauagcacgcgaacuauauaacaacaaccugacccccggagaguuaugccugcaacuacuggacgccggaaagaaauaccuacccgacuucuaccgaagcgaccuccaaaacgagcucgaccgcauuugggaaaagcagaaagaauacuaccccgagauccucaccgaaguacuaaaagaggagcugcggggaaagaaacgggacgcagugugggccauaugcgccaaauccuucguuugggaagaauacuauacagaauggaacaaggaaaaaggcaaaacagaacaacaagaacgcgagcauaaauuggaagggaucuacagcaaaagaaaacgcgaugaagcgaaaagggagaaucuccaauggagaguaaacggauuaaaagaaaaacuaucacucgaacaacuggugaucguacuacaagaaaugaauauccagaucaauaauagcagcgguuaccuaggcgcgaucuccgaccgcuccaaggagcucuacuucaauaaacaaaccgucgggcaguaccaaauggagaugcuagacaaaaaccccaacgcaucccuucgcaacauggucuucuaccgccaagacuaucuagacgaauuuaauacccuaugggagaagcaggcagaguaccacaaggagcucacgggggagcucaagaaagaaauacgcgacauagucaucuucuaccaaaggcgguuaaaaucgcaaaaaggucuggucggcuucugcgaguucgaaagccgacaaauagaaguagagaucgacggcaaaaagaaaauaaaaaccgucggaaaucgcguaauacccagaagcucaccacucuuccaagaauuuaaaauauggcagauccuuaacaacauagaagugacaguagucgggaagaaaggcaagcgaaggaaacagaaagacaacucgccaacccuauucgacggacucgacgacacagaacaacucgaacuaaacggaagccgguaucuauaccaagaagagaaggaauuacuagcccaggaacuauucgugcgcgacaaaaugaccaaaucugacguucucaaacuacucuucgacaauccccaagagcucgaccugaauuucaaaacuaucgaugggaacaaaacgggauacacgcuauuccaggcguacaguaagaugaucgagaugagcggacacgaacccgucgacuucaagaaaacggucgagaaagucguagaacacgucaaggcagucuucgaccuccugaacuggaacacagauauacuuggguucaacuccaacgaggaacuugacaaccaaagcuacuacaaacuauggcaccuacucuacagcuucgagggagacaauacucccaccggcaaugcacggcugguccagaaaaucacagaacuguacggguucgaaaaagaguacgccauuauccucgcaaacgugaccuuccaagacgacuacggcucgcucuccgcuaaggccauucacaaaauacucccacaccugaaggaaggcaaccgauacgacguagcgugugcguacgcaggauacaaacacagcgagagcucgcucacgaaagaagagauagcgaacaaagcccucaaagaucgacugacccuacuucccaaaaacaaccugaggaaucccgucguagagaagauccuaaaccagaugguaaacgucauaaacgccaucauagauacauacgggaagcccgacgagauccgcguggaauuagcccgcgaacugaaaaagaacgccaaagaaagggaagaacucaccaaauucaucgccgaaacaacccgcaaacacgaagaguucaaaauccugcuucaaucagaguucggccuaacgaacgugucacgcacagacauacuccgauacaaacucuauaaagaacuggaaagcugcggcuacaagacucuauacuccaacacguacaucccgagagaaaaacucuucagcaaagaguucgacaucgaacacauaaucccccaagcacgacuguucgacgacucauucucaaacaagacacuagaagcucggucgaucaaccuagaaaaaggcaacaaaacggccuacgauuucguaaaggaaaaauucggagaaagcggagcagacaacagccucgaccacuacuugaacaauauagaagaccucuucaaaucgggaaaaaucucuaagacgaaauacaacaaacuaaagauggccgagcaagauaucccggauggcuucauaaaucgagaccugcggaacacccaauacaucgcaaagaaagcgcuuagcaugcuaaacgaaauaagccgccgaguaguggccacauccggcacaaucaccgacaaacuccgacaagacuggcaauuaguggacguaaugaaggaacucaauugggagaaauacaaagcguuaggacucguagaguacuuugaagacaaagacgggcggcaaaucgguagaaucaaggacuggaccaagcgaaacgaccaccgccaccacgccauggaugcgcugaccguagcguucacaaaagacaucuucauacaauacuuuaacaacaaaaacgcaagccucaacuccaacacgaacgaauacgcaauaaagaacaaauacuuccagaacgggagggcgaucgccccgaucccacugagagaguuccgcguagaagcgaagaaacaccucgagaacacgcugauaagcaucaaagccaaaaacaaaguggugacgggcaacauaaacaagaccaaaaagcggggcggaguaaauaaguaucuccaacaaacuccacgggggcagcuacaccuggaaacaauauacggcagcggaaaacaauaccugaccaaggaagaaaaggucaacgcgagcuuugacaugaaaaagauagcaacaguaaguaaaagugcauaccgagacguccuauuaaagcgguuacacgagaaugacaacgaccccaagaaagccuucacgggcaaaaacuccuuggacaaacagccgaucuggcucgacaaagaacagacccgcaaggucccagaaaagguaaaaacagucacacuggaaacaaucuacacaguccguaaagaaaucagcccggaucuuaaaguagacaaggugauagacgcaggaguaaggaagauccuaaccggacggcuaaacgaauacggaaaugaugccaagaaagccuucucaaacuuagacgagaacccaaucuggcucaacaaagagaaaggcauaucaauaaaacgcguaacuaucuccgguaucucgaacgcucagagucugcacgugaagaaagacaaagacggaaagcccauucuagacgaggacagccgaaacaucccgguagacuuuguaaacacggggaacaaccaccacgucgcaguauacagaaggccuguaaucgacaaacgaggccagcuggugaucgacgaagcaggcaauccgaaguacgagcucgaagaggucguagucagcuucuucgaggcgguuaccagagcaaaucucgggcaacccaucauagacaaggacuacaagacauccgaaggguggcaauuccuauucagcaugaagcagaacgaguacuucguauucccgaacgagaaaaccggcuucaacccaaaagaaauagaucucuuagacgccgagaacuacggcgucauaucacccaaccuauucaggguccaaaaauucgcgcacaaaaacuacgucuuccgccaccaccucgagacuacaauaaaagacaccagcucaauccucaagggaauaaccuggauagacuuccgcucaagcaaaggucucgacgcaauagucaagguacgaguaaaccacaucggacaaaucguaagcgucggugaauacuga

SEQ ID NO: 6847 - RNA, 4311 nt, Artificial Sequence
  Cas9 variant
augaaauacauuaaauacauacucggacuugacaucggaagcaacucgaucgggugggcauugauacagcucgaccuccuacagaagacgaagaggauaauugcugcaggcagcagaauaauccccauggaccaaaaaguacugagcgacuucggaaagggaauaacaaucagucccacggcccagagaacgagcuaccgcaaugcccgacacugcagagaacgucaccuccuccgcagagaaagacuccaucgugugcuacacauacucggauuccucccuacacacuacgacaaacagaucgacuucuccaaaagauacggcaaguucgucgacaacacggagccaaaaaucgcguacaacgagggcaaauuccuauucauggacagcuuccaagagaugcucagcgacuucaagagccaccaacccgaccucuuuuacaccaaaaagaacggcgaagagucgaaaaucccauacgacuggacgauuuacuaccuccgcaagaaagcccucagccagaaaaucuccaaagaggagcuagcauggauaauccuaaacuucaaccaaaaacguggguacuaccagcuccgcgaagaagaggggaacaaagagaacgacuuugaaaucauaagcagcaagaucauaagcguaaucaagaaagacaaagacaagaaauauaacaaauacugguacgacauaauccucgaaaacgggcucgucuaccaggcugccuucuauaacgauuucguuuacaacuggauuaaucaagaccgggaguucaucaucgaaaggaccucucucaaaaacggcgccgaaaaagucaaacuaagcuaccuacccacauucgacgaaaucgacaagauggacaagaaggagcaagacaaauacuacaaaaagauuaaaaucaagaccgaaaacucgaucggcaacaagacuguaggcugcuacaucuacgaccauauccuacaaaacccuaacgagaaaaucaaaggcaagcucgugaggaccaucgaacgcaaauacuauaaagaagaauuaaaagccaucuuggagaaacagaucgcacugcaaccagaacuuuucaccgaccaauuacucgcggauugcauccgcgaacucuacagcaagaacgaagcccaacaacgcaaccuggccgcccgagacuucguucaccuccucgucgaagacauaaucuuuuaucaaagaccacugaggcgccaaaagagcacacucgccaacugcagccucgagucgcgaucguacaucgacaaagacucgcacacccggaaggaagcccccuugaagguaugcccaaagagcaaccccuauuaccaggaguuccgugugcuacagugguuacaaaaccuaaagauauacgaaaucgacagcgaccaggaagugacccaccaguucauuaagacgcuagaagacaaacagcaacucuucgaauuucucauggcucagaaagaaaucgauugcgaggaacuacucaaauacuuccuuaaucaaaccuacccaaacgcaaaagaaaaggcacucaaaagcgagcuaaagaaauggaaagacacauacagauggaacuauguuuacgacauuggcgagaaaaguaguaagaaauauccgaugaacgaaacgcguuacgaguuaaaacgccaccuggaaaaaguugcgaaucucccagaugauuuccuaucaucugaaguagaauaccuacuauggcaccucauauacagugugaaagacaaaguggccuacgaaaagggccucaagaaauucgcccagaaacaccaccuagacaaagacucauucguggagagcuucaaaaaguucaaucccuaucccagugaauacgggagcuuuuccgaaaaagcgauacgaaaacugcuaccacucaugagauucggagcgcacugggacuucaaccacaucgacaagaacacucagaaacggaucgaagaccucaucacaggcguagaaaacgaagaaauccguaccauccucagggagaaagccgaaaaauaucagcucgagaaggagaccgacuuccaggaucucccccucuggcucgcccaauacauagucuacaaccggcacgcagaggcuagcuccuuagagaaauggaccucagucaacgaccuagaaaccuaucugaacgaguucaaacagcacagccuaaggaaccccaucguggaacaggucguaauggaaacccuccgcguaguccgggacaucuggcaacaguacggccaaggccaggcgagcuuuuucaacgagauacacaucgaacuaggccgagagcuaaagaagacagccaaagaacgggaaaaacucucgaaacagaaccagaaaaacgaagacauaaaccuauccauaaaagaaaaacuaaaggagcuagaaaaguauaacacccgggccuauagcauuacacaccaggagaaauacaaacuguggcuagaacagaaacacaucuccccguacaccggacagaucaucucccccgagaaccucuuuacagacaacuaugagaucgaacacauaaucccgcaaucccguuucuuugacgacucccucagcaacaaaguagucugcgagagcaucgucaacaaggccccuuacaaagaccgacaacucggacuugaguucaucaagaaucagggcgguagaauaguaaaagaacuauccaaagagaacaaaacaauaaaaaucuuuaccgaggaacaauaucgcacuuucauaaaagagcacuacagcaacaacccagaaaagacaaagaaacuucuccucgaagaaauuccggagaagauggucgcacggcaaaugaaugacacgugcuacauaagcaaauucaucuccgaaauccuaagcaaaauuguacgcagcgacgaacaagacgaaggaguccacuccaagaacgucauccuaugcaccgggaaaauaaccuccauacuacgccaggacuggggucuaaacgacauaugggacaaccucauacucccccguuucgagcgcaugaacaaccugcugcaaaaagaaaaauuuacaauauacaguauugagaaacagaagaaaauccccgucguccccaucaaugaccaauucaaauccuuccagaagaaaagaauagaucaccgccaccacgcgauggacgcaaucaucauagccugcaccaccagagagcacaucaacuacauaaacaaccaacacgcccuggaaaaggaaaaggacaaaaaggaaaaacaagaggagcgggacaaacuucgcgagaaacugugcaucaagaaauacaauaaccgauccgaggggaacuacucauggauauucaagaaaccgugggacaccuuuacccaggagguacgagucgcacuagaggacaucgucgucucauuuaaacagaaucuacgcgucauaaacaaagccacgaacuauuacgaaagauggguagaagagaacggcaaauacaucaaaaagauggucaaacaggaaggaaccaacugggcaauacgcaagccccuacacgaagaaaccauuuccgggaagauauaccucgaccgggagaagauaaccaaaaacgacauccuaacagccacccguaaaaccguugacucgagcuucgaugacaaaagaaucaagaaaaucaccgacacaggcauccagaaaauccuuuugaacuaccucaaauacaaaggcucccccgaaaucgcauucucccccgagggccucgaggaacucaacaaaaaccucuccauauacaacgacggcaaaccccacaaaccaaucuacaaaguucgcauauacgagaagggaucgggccgguucgcccugggagaaaaaggaagaaaguacaagaaauacguccagggggccagcaacuuguauuucggcaucuaccagggagccaaacgcucguucgccacaaucccccuaaacgaggucauugagcgacagaaacaaggucucccaucggucccugaguacaacgaaaagggagaccuacuccuauucagccugaguccaaaugaccucguauacgugccuaucgaaggagaaaucaucgaaaacauagacuuucgcaaccucucgaaggagcaaaaggagcggaucuacaacgugaacgauuucuccucuaccugcuacuucacacccaaccgaauagcaaaggccauauucccaaaggagguagaccuccaacgcaagggcgacaagcucagcggcagcuacgacacaaaaacugcgagcuuggaagggauccagauaaaagaagucugcaucaagcucaaagucgaccgacucggcaacaucagcaaagcauga

SEQ ID NO: 6848 - RNA, 4314 nt, Artificial Sequence
  Cas9 variant
augaaauacauaaaauauauucucggccuagacaucggcagcaacuccaucggaugggcgcucauccaacuugaccugcuacagaaaacgaaaagaauaauagccacgggcucccgaaucauaccaauggaccaaaagguccuauccgacuucggcaaggggauuaccaucucccccaccgcucaacgaaccucauaccggaacgcucgccacugcagagaaaggcaccuucuaaggcgcgaacgacuucauagaguccuucacauacuuggcuuccucccaacacacuacgacaaacaaaucgacuucuccaagcgcuacggaaaauucgucgacaacaccgaaccgaaaauagccuacaacgaacgaaaguuccuauuuauggacagcuuccaagaaaugcuugcugacuucaagauccaccagccggacuuguucuacaccaagaaaaacggagaggaaagcaagaucccauacgauuggaccauauacuaccuaagaaaaaaggcguugagccgcaagaucagcaaggaggaacuggccuggauaauccuaaauuucaaccagaaacguggcuacuaccaguuacgagaagaagaggaggaaaacaaggaaaaugacuucgaaaucauauccagcaaaauaaucagcgugaucaagaaggacaaagacaaaaaauacaacaaguacugguacgauaucauccucgagaauggcuugguauaccaggccgcauucuacaacgacuuuguauacaacuggaucaaccaagaccgagaauucauaauagagcgcaucuccuuaaaaaacggaacagagaaggugaaacugagcuaccuccccacguucgacgaaauagacaaaauggacaaaaaagagcaggacaaguacuacaagaaaaucaagaucaaaacggaaaacagcaucggcaacaagaccgucggaugcuacauauacgaccacaucuuacaaaacccaaacgaaaagaucaaagggaagcuuguucgcaccauagaaagaaaguacuacaaagaagagcuaaaggcaauccuggaaaagcaaguagcgcugcaacccgagcuauucaccgaccaacucuucgccgacugcauacgggaacuauacaguaaaaacgaagcacaacaacgcaaccuggccgcacgugacuuuguccaccuguucguagaagauauaaucuucuaucaacgaucuuugcgccgacaaaaaagcacccuggcgaacuguucgcuagaaucgcgaagcuacaucgacaaagacagccauacgcguaaagaagcaccucuaaaggugugucccaagucaaacccauacuaccaggaauuccgugugcuccagugguuacagaaccugaaaauauacgagaucgacaccgaccaagaggugacccacgaauucaucaaaacgcuagaagacaaacagcaauucuucgacuuccucaugaaccaaaaggagaucgacugcgaagaauuacuuaaguacuuccuaaaccagacauaucccaacgcccgagaaaaagcccugaagagcgaauuaaaaaaauggaaggauaccuaccgauggaauuacgucuaugacaucggcgaaaaaagcuccaagaaguaccccaugaaugaaacacgauacgagcuaaagcggcaccuagaaaaagucgccaaccugcccgacgacuuccuauccagugagguagaauaccuccuauggcaccuaaucuacucgguaaaggacaaaguugccuacgaaaaaggccucaagacuuucgcgcaaaaacaccaccucgacaaggacucguucguggaaagcuucaaaaaguucaaaccauaccccucugaguacggauccuuuuccgagaaggcuauacgcaagcuccugccccuaaugcgauucggcagcuacugggacuucaaccacauagacaaaaacacccagaaacgaaucgaagaccucaucacgggaguugaaaacgaagaaauacgcacaauacucagagaaaaggcagaaaaauaccaacuagaaaaagaaacagacuuccaagacuuaccccucuggcucgcgcaauacauagucuacaauaggcacgccgaagccucaagccucgagaaguggaccagcgugaacgaccuggagacguaccucaacgaauucaagcaauacagccucagaaaccccaucguagaacaggucgugauggagacccuccggguagugcgcgacaucuggcagcaguacggccaaggccaagccucguucuucgacgagauccacauagaacuaggacgagagcucaaaaagacagcgaaggaacgugagaaacuaucaaaacaaaaccaaaaaaaugaagacaucaaucucuccaucaaagaaaagcuaaaggagcuagagaaauacaacaccagagcauacucgaucacacaccaagaaaaauacaaacucuggcuagagcagaagcacaucagcccauauaccgggcagaucauaucccccgaaaaccuguucacggacaacuacgagaucgaacacaucauaccccaaucacgauucuucgacgacagccucucgaauaaagucgucugcgaaagcauuguaaacaaagcgccauacaaagaccgacagcuagggcuagaauucaucaaaaaccaaggaggcagaaucguaaaagaacucagcacagagaacaagacgaucaaaauauucaccgaggagcaauaccgaacguuuauaaaggagcacuauuccaacaaccccgaaaaaacaaagaaguugcuauuagaagagauucccgaaaaaauggucgcccgccagaugaacgacaccuguuacaucagcaaguuuaucagcgaaauacuauccaagaucguccgcagcgacgaacaagacgaaggaguccacuccaaaaacguaauccuaugcacaggcaagaucacgagcgcgcuuaaacaagauuggggggucaacgacguauggaaugaccucauacucccucgcuucgaacguaugaacgaucucacccagucaacccuguucacuacguacaacgaaaaauaccaaaaguaccugccaaccguccccauggaauauagcaauggguuucaaaaaaagcgaauagaccacaggcaccacgccauggacgccauaaucauagccugcgccaccagagaacacauuaacuacaucaacaaccagcacgcacuagaaaaaggaaaggacaagaaagaaaaacagaaggagcacgacaagcuucgcgaaaagcugugcauuaaaaaagacaauaaagguagcgaagaaaacuacaguuggauauucaagaaacccugggacaccuucacccaagagguacaggccgcccuagaaggcauugucguauccuucaaacagaaccuaagggucaucaacaaggccaccaauuacuaugaaagaugggucgaagaaaauggcaaauacauuaagaagauggugaagcaagagggcaccaacugggccauccgaaaaccgcuccacgaagaaaccauaagcggaaagaucuaccucgaccgcgaagagaucaccaaaaacgauauccucaccgccacgcgcaaaaccguugacagcucauucgaugaaaaacguaucaaaaagaucaccgauacggggauccaaaaaauucuccucaacuaccuaaaauacaagggcucgcccgagauagcauucagcccagaagggcucgaagagcugaacaaaaaccucagcaucuacaaugacggaaaaccacacaagccaaucuacaaggucagaauauaugagaaagguucaggccgauucgcacucggcgagaagggucguaaauacaaaaaauacguacaaggcgcaccgaaccuauacuuuggcaucuaccaaggagccaacaaacgaucguucgcaacaauaccacuuaacgaaguuauagaacgccaaaaacaaggccgaccauccauccccgaauacaacgaaaagggagacccccuccucuucucgcucagccccaacgaccucgucuacgugccgguagagggagaaaucaucgaagauauugacuuccaaaaccucucaaaagaacaaaaagagagaauauacaacguaaacgacuucuccuccacgugcuacuucaccccaaaccggaucgcgaaagccauauuccccaaagaagucgacuugcaacggaaaggcgacaaacuacccgguagcuaugacacaaagaccgcaucccuugaaggcauacagauaaaagaggucugcaucaagcucaaaaucgaucgacuagggaacaucagcaaggccuga

SEQ ID NO: 6849 - RNA, 4317 nt, Artificial Sequence
  Cas9 variant
augaaaaccauccucgggcuggaccucggaacaaacagcauagggugggcccucaucaaacaaaauuuugagaacaaguacggcgaaauccuaggaaugggaagccgaauaaucccuaugucccaagacauacuaggcgaauucggaaaaggaaacagugucagccaaacagcagcacgcacagacuaucgagccacgcgaaggcuacgugaacgauuccuacuucggagagaaagacuucaccgaguccucaauguucucaacuuccuucccgaacacuacgcaagccaaauagacuuugacaaaagauucggaaaauucaaagucgaaacggagcccaagcucgcguggaaaaauauugacggaaaguucaguuuccucuuucaaaccagcuucaacgagaugcucgaagacuuuaaggcgcacggacaggaccuaaaaguucccuaugacuggacuauauacuaccuccgcaaaaaggccuuaagccaaaaaaucgagaaagaagaacuggucuggauccuacucaacuucaaccaaaaacgcggcuacuaucaacucagaggcgaagaagaggaggagaacccuaauaaauuaaucgaguucuacucacugaaaaucaucgauguccuggcagacgagccgcagaaaggcaaauccgacauaugguauagccucguacucgagaacggauggaucuaccgaagauccaguaagacaucccuacuugacuggaaagauaagauucgagacuucaucgucacaacagaccuaaaugacgacggcucagucaagacggacaaagagggcaacgaaaaacgcucauuccgcgccccaggagagaacgauuggacgcuugugaaaacaaagacggagcaagagauagaccgcucacggaaaacuguuggcaacuacaucuacgagacgcugcuacaaaacccuaaacaaaaaauaaaaggcaaacuaguacgaacaaucgaaaggaaauuuuacaaagaagaacuuaaaaggauccuagaaaagcaaaaagaauuccaccgggaacuggagucgaacgaccuguacaacgacugcaucagagagcucuaucgcaacaacgaggcacaccagcucacgcuauccaaaaaggacuucgugcaucucuuuauggaagacauaaucuucuaccaacgcccauuaaaaucccaaaaauccuccaucagcaacugcacgcuggaauucagaaaauacaaggacgaaaacgggauagaacacacccaguuccugaaggcaauccccaaaucaaacccauacuaccaagaguuccggaucuggcaauggaucuuuaaccucaacauauacaaaaaagacaacgacgacaacgucacgaaagaauuccuaaauacaacgcgcgauuucgaaaaccuauucgaauuccugaacaacaggaaagaaauagaacaaaaaccgcuccucaaguuccugcucgagcaaaaggaguucaaaggaaaacugcucaacgccgaaaccgagaaauucagauggaauuacgucgaggacaaaaaauacccguguaacgaaacucgcacaaugauauccgaacgacugaaaaaaguggaaaacauaucggacgacuuccucacccgagagauggaacaaaaaauuuggcacaucauauacuccgucaacgacaaaaccgaauacgaaaaggcgcucaagagcuucgcggaaaagaacaaccuagacgagaacucauuguucgaggcauucaaaaaauuaccaccuuucaaaucagaauauggcagcuuuagcgagaaagcaaucaaaaaacuacugccgcuuaugaggcuagguaaauacuggucauacgccaaaauagaccucuacagcaagaaccgcauacaaaaaaucaucaccggggaguucgacgagaauaucaaggaccggguccgggagaaagccauuagacucaccgcugagaacgauuuucaaggccuccagcuguggcuggcacaauacaucguguacggccgucacagcgaggccucaaugaucggaaaauggaauucggccgacgaccucgaagaguuccucaaggaauucaagcaacacucccuccgcaaccccaucguagaacagguaaucaccgagacccucagaauugucaaggacauauggcugaaauacgggaacggcgcaaaagacuucuucaacgaaauccacaucgagcucggacgagagaugaaacagacgaaagacgagcgagcaaacgcaaccaaaacaaucacggaaaaugagaacaccaaucuuagaaucaaagcgcuacucgcagaaaugaugaacgaccacagcguggagaauguccggcccuacucccccaugcaacaggaaauacucaaaauauaugaagacggaauccugaaauccgacaucgaaauagacgacgauauacuaaaaaucucuaagacggcacaacccucaagcagcgauuuaaaacgguacaaacucuggcuagagcagaaguacaaauccccguacaccgggcaaaucaucccucugaacaaacucuuuacuccggaauacgaaauagaacacaucauaccgcaaucccgauauuucgacgacuccuucucgaacaaaauaaucugcgaauccgcuguaaacaaacugaaggacaacuacauaggccuaggcuucauaaagcaguucgggggaaccaucauagaaugcggguucgguaaaagaguaaaaguguucgaggucggcgaguacgaggaauucgucaaaaagcacuacgcgaacaaccgagggaagcgcaacaaacuacugcuagaagagaucccagagaaaaugauagaacgccaaaugaacgacacccgacauaucuccaaauacauuagcggaauccucucccacaucguucgagucgaggauggaacagacgagggcgugaacagcaagaacguaauaccaggcaacggcaagauuaccacccaacuacgccaagauuggggccucaacgacguauggaacgaacuuauccuuccacgauucgaacgcaugaaucaacuaacgaacuccacugauuucacguccuggaacgagaaccaccaaaaauaccuccccaccgucccggucgaguucuccaaaggcuucagcaaaaaacgcaucgaccaccggcaccaugcacuagacgcacugguuauagcaugugcgacaaaagaccacguaaaccugcucaacaaccagagcgcgaaauccgcaaccaaacguuacgaucugaagaaaaagcuuaugaaauucgagaagacaguauauaaggacccccaaaccgaaaagcguaucgaaagagaggucccgaaacacuuccuuaaacccugggaaacuuuuaccguagacgccaagaaucgccucgaaaccauaauuguauccuucaaacaaaaccuacgaguaaucaacaaagccacaaacuacuacgagaaauacguagaaaaagacggcguaaugaugaaagaacgggucgagcaaacaggcacaaacugggccauccgcaaacccaugcacaaggagacggucucuggcaagauugacuuaccauggguaaaagucccgaaaggcaaaauacuuacagccaccaggaagagccuagacaccucauucgaccuaaaggcaauugcaagcaucacagacacgggcauacaaaaaauccugaaaaacuaccuggaguucaaggaguccccagaacucgcguucucuccagaaggcaucgaagacaugaacaaaaacaucgaaaaguauaacggcggccgaccacaccagccgaucucuaagguacgagucuuugagcuuggaucaaaauuccaaguggggcaaacaggaaacaaaaaagacaaauaugucgaggccgccaagggcacaaaccucuucuucgcaaucuacgaagacaagaaggguaaacgcuccuacgaaacuauaccgcuaaaugaggucaucgagcgccaaaaacagggacucuccguggucgaccugaagaacguaaacgacuucuuucuuugccccaacgaccucgucuacauaccgucgggcgacgaauucgaaaaccguggcagcaucgaaaucgagaacaucacaaaagagaaaagcgaaagauucuacaagguugucucauucagcgggagccagaucuucuucguacgccacgacauugcggugucuaucguuaacaaaggcgaauuuucaacccucaacaaaauggaacgcgcuauagacggcuccauggucaaggaaauaugcaucaaguugaaaaucgacaggcuuggagacguccugaaagccuga

SEQ ID NO: 6850 - RNA, 4317 nt, Artificial Sequence
  Cas9 variant
auggucaaaaagggauacacaauaggccucgacaucggcacaaccuccgucggcugggcugucacggaugacgacuucgagcuagucaacaagaaaaugucuaucaaagacaaaagcggcucuacgaucaagagggugcggaaaaaccuauggggaguccgccucuucgaugaggcgaagacagcggagaacacccggcggacccgcggcgugagacgucgaauccggcgccguaaggagcgccucaacuaucuccaaggcaucuucuccucggagauggcaaaaauggacgagaauuucuucaugcgccuugaagagagcuucuucaaacucucagacaagagcgaacagaacaaauuccccuaugcgcuauucaaaaacgagauagaggagaaagcauauuaccgacaauuuccaaccauuuaucaucuuagaaaacaucucauggaacaugaggaaucagaccuaaggaagaucuaucuaggccugcaccauauacugaaguaccgcggccacuuugugcaggaaggccaaaagauggacguagccaacauugauauacaggguaaucuaaaagaacucuucaacgcccucaacgagaacuuuagcaacaaagaggaugacuucgagcaagagcggaugaaggacggcguaaagcgcgccaaaguucucuuugacaccgagaaacuagccgcagucgaggagauccuaaaagaaaagauaagcaaaagcuggaaagugaacaagauaucaaaaggcauccuggccgaaaagaaagaccucccaaucuucaaagccaucgucgggaacaaaauagaccucgccgggaucuucgacugucccgacuacgcggaaaaaguaaacgaaucaaucaaagaacucaaggauaaagucuacuucaacaaagaggacuucgaagaaacauuugagaaacugucucagcuacuuaaggaagaggaacuugagauccuaauccucgcccggaaguguuaugaagccgugcugcuggccgacaucaugcaaggcgaacaaucacuaagcgacgccauggucgccaaauacaaugaccacaagaaggaccuagucaucuucaagaaauucgucauagacuacuucagcgaagacgucuacuucgaccuguucaaaaauacacaacuggccgggaacuaucacaguuacguaaaaggcgaaaggaaggggaacaaauuuaaccacgccagccucgacgacuucuacaaauuugugaaaaaggaacuggacaagaaagcagaggaacugucagagcaccccguauacaaacaaauacuccagaaaauugaacucgagaccuuccuuccgaaacaacggauguucaagaacggcgcaauacccuaccagguacaucuccacgagcuccgggcaaucaucaaaaagcaagaaaaacguuuccccuuucucgcagagaaaauaauuauaaaggacaaucagaaggacauaagcgaauacaaaaucgaaacccuaaugaaauuccgcauacccuacuacgucggaccccucaucgaagcaagggaaggcgaacucggcaaaaagcggacaaauuacagccgauucgcauggaugcaaaagagccccgaaagccaaaacaucggcaucacgccauggaacuuccacucugucgucgacaaggacgcaucggccucugaguucaucgaacgcaugaccggguucugcagcuacuuuccggaagaaccaguucugccaaagaacagucuaauauaccaacaauucacgguauuucaagaacucagcaucgucggcuacuacgacgaacagaaccgaaaacacuaucuggacggggagaccaggcgacgcauauucgaggaccucuucaagaaaaaccgaacagugagcgccggccuacugcgcaaauggcugguaugcaaccagcggaccagucaagaggaaaaagagauuagacucuucggccuggaucucaagaaaaacggccucggcagcgggaacuucaauacaaaauauacuaccuaccuagaccucaaagacgcagggaucaccgaaaagcaacucaaacagcauaaagacuucuucgagaaaaucguaaaauaccaaaccaucuucgaagacaaaaagauuuuaaagcgccgcaucauccuauuaaacgaagaacagccccuccuauccgaagaacaaaucaagaaccucgcgaagaaacacuauacuggauggggcaaccugucgcucaaacugauagacggcauucaagacaaaggaaaaacaauacuggauuaccucgagacacaagacuacaaucagaaccucaugcagcucaugaacgacgaaaacaagagcuuugaaaugcaaaucgagcaagccagggccggaaaaguccaauucggcaaaaucgacuauuccuucgucgaacaacuagccggcagccccgccaucaagcgcggcaucuggcaaagccuucaaaucguggaggaacucguugcguuccuggggaaggaaaauaucaagaaaauagugaucgagauggcgagggaaaaccagagcagcaaacggaccaagucccgccagaaacagaucgaagcccucuaccaaaaaguaacaggcgaccuuaaaaaugagcaggagaaaaucgacguaaugcaaaacuucgauaacgaacgaguguuccuauacuaccugcaaaacgggaagugcaugcacagcggcgaaaaacucgaacucagccaacugucagaauacgaaaucgaccacaucauuccacaaacauacauaaaagacgacagcuuugacaacaaaguucucguaaccagaaacgcaaaucaacaaaaaggcggggacguucccuccuacgacguaaucgacaaaaugaaauccuacugggaaaagcucaaggagaacaaccucaucuccgaaaagaaauucgcaaaccugaccaaaggaaaauucgacgaucaacagcugucgggcuucaucaaccgacagcuuguagagacccgacagauaacuaagaacguagcaauaauucuagacaaaauauauaacgacgaagccaaaaacgaaaaggagguagcaauaaucacccuuaaauccgcccugacaucgcaguaccggcagggcaucauauacguccccaacgacgacuucgacgaacuuaagcuagucaguaaaaccaacucgcggcugaaagaaguaaaacugcacgacggcuucuacaaaguacgagagaucaacgacuaccaccacgcgcacgacgccuaccuaaacaacgucguggccacguaccuauacgaagccaugcccgaccuaagacccuuguucguauacggggagcacagcagggaaauccauaaaagauuucuaggcaaguacgcgacaacacgcaagggccaauuuaagcaacugcucguagacaugcaggacgaguacuggaugcgcaaggacaaagaagguaacuucaucgauggcgagauccuauggagacgggacgaagugcuccaaaucguaaagaaaguacucgacuaccgaaacauacaaaucaccaagaaacuugaaaugauggugaccggcggagaagaaaaaucauucuaccaagacagucgcugccguaaggauaaaacagccauaccauauaaaaccaauugggauccgagcaaauacggcggcuucaaaucuccccgaacagccuacgcaaucccggucaucaagaaaaacaaacccaaacuggaaccaguacuacucgucaacagaagcaaaguagagaccgacggacaauuugacugcgaaaaguucaaggagcuuaacccgaccuuaaaaauccucgggcagccaaucuggaaauaccagucauucgagauguucgauggaaccaaacgcuacaucgccuccgccucggaaauccacaaagggaaccagaucaaguuuucccaagaacacaugaaauucaucagcugcugccaaaaguacgacgaagucaaaaacaagcuagccuucgacuuugucaacgaauccaaacaccuguuccaagaaauccuuacagccaucaaggauaacauccaccguuaucgccucaucgccgaaggcauugaaguucaccgcaaguucuccaacaugcuggagaacaucgaaaagcuaagcacccaggaacucguugauaauuugcuggacgccaucaacaucaccagcgucggcaccacaaacaacgccuuuggccgcguccguuauaaaggcaguuaccucaacgaaaucuggucggccacccuaauucaccaaucgguaaccggcuuauacgagacacgcgaaaaacuaaucuga

SEQ ID NO: 6851 - RNA, 4323 nt, Artificial Sequence
  Cas9 variant
augaaaaccauacuaggucuagaccuaggcacaaacuccauaggaugggcccuaguugagcaagacuucgaaaauaaacaaggucuaauccugggaaugggcagccguaucauaccgauggacgcgggcauuaucggaaaauucgccgaaggcuccagcauaagccaaaccgcagagcguacaggcuaccgcagcauccgacgucuacgagagcgacacuugcucaggcgggaaaggcugcaccggguccucaacauacuaaaauuccugccagaacacuacgcagccgaaaucgacuucgaaaaacgcuucggccaauuccuggcagaaaccgaaccaaagcucgcauggaagaaaucggcggaaggaaaauucgaguuccucuuccaacgaucauuugacgagauggucgccgacuucaaagccaacgggcaagacauuaaaauuccauacgacuggacaaucuauuaccuccgcaagaaagccuuaacccaaaagaucucaccgcaagaacucgcauggaucauacucaauuucaaccaaaaacgagguuacuaccaacucagaggagaggaggaggaagagaacccgaacaaaaaggucgaguucuacucgcuaaagaucguagacguaguugccgacgaacaaccaaacaagaagggggacaccugguacagccuacaccucgaaaaugguugggucuaucgcaggucgucgaaaaucccccucuacgauuggaaggacaaagugcgagacuucaucgucacaacggacauaaaugaagacggcucggaaaagcuagacaaagacggggaggucaaacggucauuucgagccccaaaggaggacgacuggacacucaucaaaaagaaaacagagcaagagaucgaacaauuuaaccaaaccgucggcaguuacauauacgaggcccuccucgacaacccgacgcagaaaauaagaggaaaacugguccggacuaucgagcggaaauucuacaaauccgaacuaaagaaaauacuagaaaaacaaauagaacuacagccagagcuguucaccgaggaccucuacaacgcaugcgcccgggaacuauaccguucaaacguagcucaccagcaacagcucucgucaagggacuucgucuaccuguuccuaaacgacauaaucuuuuaucaacgcccgcugaggucccaaaagucccugauuucuaacugcucccucgaguucagaaccaucaaagacaaagacggcaacggacaaauaaucuaccuaaaagccauaccuaagagcaacccauauuaccaagaguuccgcguuuggcaauggcuauacaaccuaaaaaucuucacgaaagaagacgacaaagacgucacgaaucaguucaucaauaaaguggaagaccuggaagcacuauuugaguuccucaugaaccaaaaggaaguaaaccacaccgacauacugacauaccuaauagaaccaauagugaaaaguaaauaccccaaugccaaaggcaaagccuucaaagaugaacucaagaaggaacuuaaaaaguaccgcuggaacuacguauacgacgcagacaaagacgaaagcaaguccuaccccaugaacgagacccgguaugaacuacgcaagcggcuagacaagguagaaaauguuccggcagauuucaugacgcggaaaauagaacagcaccucuggcacaucauauacuccguuacggacaaaauagaguuugaaaaggcgcugaaaucguucgcaaacaaauacgaccuacaccaagagagcuuugucgaaaacuuuaaacgcuucaagcccuucgacagcgauuacggcaccuauucagaaaaagcaaucaagaaacuccuaccccuaaugagggucggaaaauacugguccugggaaggaaucgacaacaacacaaagaaacguauugguaaaaucauaacgggcgaguacgacgagaccaucaaaaaucgcguuagggagaaagcaaucgaccugacggaggaaaaccacuuccaaggacuccaguuguggcucgcccaguacauaguguacgacaggcacucagaagcagacaucgccggaaaguggaacaguguugcugaccuagaacaguaccuaucggaguucaaacaacacucccucagaaaucccauaguagaacaagugauaaccgaaacccuccgagugguacgagacaucuggaaacaguacggcaaaggagccaaagacuacuucgacgaaauccauaucgagcuggggcgagaaaugaaaaacacagccgaagaaaggaagcgacucagcagcaucauauccgaaaacgaaaccacgaaccuccguauacgugcaauccucgaggaacuuauguacgacgaaaauauggaaaacguccgccccuacagcccgaugcagcaggaagcccugaaaaucuacgaggacgguguucucagcucauccgucgagauccccgaagacaucgagaaaaucucgaaaaaguccgaacccaccaaauccgaaauccaaagauacaagcuauggcuagagcaaaaauaccgguccccauauaccggccgcccuauuccccucagcaaauuauucacaccagcauaccaaaucgagcacaucauuccccaggcgagguucuucgacgacggcuucagcaacaaagucauaugcgaguccgaaguaaacgcacugaaagacaaaaugcucggacuagaauuuauccagaauuacuacggccaaaagguuaccaccagcuucggggagguaacaauacucaccgaagacgccuacaaagccuucguaaaagaacacuacgacaaaaaccgcaguaagcgcaauaagcuccuccucgaggaaaucccagaaaagaugaucgaucgccagaugaacgacaccagauacaucagcaaguauauaucgaagguacucagcaaccucguccgcggcgagaaagacgaugaaggcguuaacucgaagaacaucaucccgggaaacggcaagaucagcggaacccuaaagcaagacuggggacucaacgacguguggaaugaccuaauccucccccgauucgagcguaugaaccagcucacgaacagcacagacuucaccgccuggaaugaaaaacaccaaaaauuccugccgacaaucccgcucgaacuaucgaaaggauuccaaaagaaaagaaucgaccaccgccaccacgcccuggacgcucucaucauagcuugcgcgacacgcgaccacgucaaccuucucaacaacaaacaugccaaaucccgaaacgaacgcuacgaccuacagcacaagcuccggcacaccacgcccuggcaagacaaagaaggaaagguacgcaccaaauuuacagaguucaagaaacccugggaaaccuuuacccaagacaccaagaaagagcuggagaaaauagucguauccuucaaacaaaaccuacgggugauaaacaaggccacaaacuacuacgagaaaaucgucgacggcaaaaaggucauguucaagcaggaaggaguaaacugggccaucaggaaacccaugcacaaggagaccgugaguggaaaaauagaccucccaagggugaaagucagcaaaggaaagauccuaaccgcaacaagaaagucacuagacacuuccuucaacgcgaagacaauccucagcaucacagauaccgguauccaaaagauccuccucaacuaccuaaaggccaaaggcaauccagaacucgcauucucacccgaggguauagaagaaaugaaccagaacaucagccuguacaacgacggcaagccccaccaaccaauccuaaaggugcgaguauucgaacagggaucaaaauucccccuaggcgagaccggaaacaagaccacgaaauauguagaagcagccaagggcacaaaccucuuuuucggcgucuacgagaacaaccaaggaaaaagaagcuacaacacgauaccacugaaucuggugaucgaaaggcagaaacaaggacuuaacucagucccagaaacaaacgagaaaggccaccgccucuuauucagcuugucuccgaacgaccucgucuacgugccaaucgagggcgagguguucgacaaaaccaaccccgacgucaauagaauauacaagauagucucauucagcgggucacaaauguucugcguacgacaagacguagcaacguccaucguguauaaacucgaguucuccucgcucaauaaaauggaacggaccauagacggcauaaugauaaaggagauaugcaucaaacucaagguggacaggcuaggaaacauauccaaggcguga

SEQ ID NO: 6852 - RNA, 4323 nt, Artificial Sequence
  Cas9 variant
augaaaacaauauugggccuggaccucggcacuaacucaaucgggugggcacuugucgaacaagacuucgaaaauaaacagggccuaauccuggguauggguuccaggauaauacccauggacgccggaaucaucggaaaauucgccgaaggaucgagcaucucgcagacugccgaacgcaccggguacagguccauacgacgacuacgcgagcgccaccuacucagacgcgagcgacuccaccgcguccuaaacauccucaaauuccuccccgagcacuacgcagcagaaauagacuuugaaaagcgauucggccaauuccuagcagagacagaacccaagcuagccuggaagaagaacgccgaaggcaaguuugaguuccucuuccagagaucauucgacgaaauggucgccgacuucaaagccaacggccaagauaucaaaauacccuacgacuggacgaucuauuaccuccgcaagaaagccuuaacgcagaagaucucaccgcaagaacucgccuggauuauccugaacuuuaaccaaaaacguggcuacuaccagcucaggggcgaagaagaagaagagaacccaaacaaaaaggucgaguucuacagccuaaaaaucgucgacguagucgcugaugaacagcccaacaagaaaggagauaccugguacucccuccaccucgaaaacggaugggucuaccgcagauccagcaaaauccccuuguacgacuggaaagacaaagucagagacuucaucgucaccacagacaucaacgaggacgguucggaaaaacuagacaaagacggggaggucaagagaucauuccgggcccccaaggaggacgacuggacacuuaucaaaaagaaaacagagcaggagaucgaacaauucaaccagaccgugggaagcuacauauaugaagcgcuucucgacaacccgacccagaaaauacgcggcaaacucguccggacaaucgagcgcaaauucuauaaaucagagcuuaagaaaauacuagagaaacaaauagaacuccaacccgagcuauucacagaggaccucuacaacgcuugcgcuagggaacucuacagaaggaacgucgcacaccagcaacaacuauccagccgggacuucguauaucucuuccugaaugacaucauauucuaucagcguccccuccgaucucaaaagagucucauaagcaacugcagccuggaguucaggacuaucaaagauaaggacggaaacggccaaaucauauaccuuaaagccauaccaaaaucgaaccccuauuaccaagaguuccggguguggcaaugguuguacaaccucaaaaucuucaccaaagaagacgauaaagacgucacgaaccaauucaucaacaaggucgaagaccucgaagcccuguuugaguuccucaugaaccaaaaagaagugaaccacaccgacauauuaaccuaccuuaucgaaccgauugucaagagcaaauacccuaacgccaaaggcaaagccuucaaggacgaacucaagaaagaacuuaagaaauacagauggaacuacguguacgacgcagacaaagacgaaagcaaauccuaucccaugaacgaaacccgauacgaacucaggaagcgccuugacaaaguggaaaacgugccggccgacuuuaugacccgcaagaucgagcaacacuuauggcacaucaucuacuccgucacagacaagaucgaguucgaaaaggcgcucaagagcuucgcaaacaaauacgaccuucaccaggagagcuucguagaaaacuucaaacgcuucaaacccuucgauucggacuacgggacuuacucagaaaaggcgaucaaaaagcuccuaccccucaugcgcguaggaaaauacuggaguugggacaucauagacgauaaaacaaaaacccggaucggcaagaucaucacaggcgaguacgacgagaccaucaaaaaccguguccgggaaaaggccaucgaccucacggaagaaaaccacuuccagggacuccaauuauggcuggcacaauacauuguuuacgaccggcacucagaagcggacauugccggaaaguggaacagcguagccgaucuagagcaauaccugagcgaauuuaaacaacacucccugcgaaauccuaucgucgagcaaguaaucaccgagacccucagagucguacgggacaucuggaaacaguacggcaagggagcaaaagauuacuucgacgagauacacauagagcucggcagagagaugaaaaacaccgcggaagaacgcaagagacucaguagcauaauaagcgaaaacgaaacgaccaaccugagaauccgagcaauccuagaggaacuaauguacgacgaaaacauggaaaacguacgcccguacucaccaaugcagcaggaggcccugaagauauacgaggacggcgugcuaaguucaagcguagaaauccccgaagacauagaaaagauaucuaagaaaagcgagcccaccaagagcgaaauccagcgguacaaacucuggcuagaacaaaaauaucgauccccauacaccggacgaccaaucccacucuccaaacuguucacuccagccuaccagaucgaacacaucauaccccaagcccgauucuucgacgaugguuucucaaacaaggucaucugcgaauccgagguaaaugcccucaaggacaaaaugcucggccucgaguucauacaaaacuacuacggccaaaaggucacgaccagcuucggagaagucaccauacuuaccgaagacgcguauaaggcauucgucaaagaacacuacgacaagaaccgcuccaagcggaacaaacuacugcucgaagaaauccccgagaaaaugauagaccgccaaaugaacgacacccgauacauaagcaaauauauuagcaaaguccuuucuaaccuaguccgaggggaaaaagaugaugaaggcgucaacagcaagaauaucauccccgggaacggaaagaucacuggaauccuaaagcaggacuggggacuaaacgacgucuggaacgaccuaauacuuccccgcuucgaacggaugaaccaacuaaccaacagcacagacuucacggccuggaacgaaaagcaccagaaauuccuacccagcguaccccuagaacucagcaagggcuuccaaaagaaaagaaucgaccaccgccaccacgcacucgacgcuuuaaucaucgcaugcgccacccgcgaccacgucaaccuccuaaauaauaaacacgccaaguccagaaacgagcgcuacgaccuacaacacaaacuaaggcacaccacccccuggcaagacaaagagggcaaaguaaggacgaaauucaccgaauuuaaaaagcccugggaaacauucacgcaagacaccaagaaagagcuggagaaaauagucgugaacuucaaacagaaccugcguguaaucaacaaagccacgaacuacuaugagaaaaucguagacgggaaaaagguaauguucaaacaggaaggagucaacugggcaauaagaaaaccaaugcacaaagaaaccgugucgggcaaaauagaccucccgagagucaaagucaguaaaggcaaaauacucacggcgaccaggaaaucccuggacaccucauucaacgccaagacaauacucucaauaaccgacacaggaauccaaaagauccuccugaacuaccuaaaggccaagggaaaucccgaauuggcuuucagccccgaagguauagaagaaaugaaucaaaacaucagcuuauauaaugacgguaaaccccaccaaccaauacugaaagugcgcgucuucgagcaaggcucaaaguucccacucggggaaaccggcaauaagaccacaaaguauguagaagcagcaaagggcaccaaccuauuuuucggcgucuacgaagacaaccaaggaaaaagaagcuacgacacgauaccacugaacaucguaauagagagacaaaagcaaggucugaacucagugccagaaacaaaugagaaaggucaccggcuccucuuuagccuaucgcccaacgaccucgucuacguccccauagaaggugaagucuucgaugagacgaaccccgacguuaacagaaucuacaaggucguaucauuuuccgggucgcaaauguucugcguccgccaggauguggccaccaguauagucuacaaacucgaguucagcagccucaacaaaauggaacgaacaaucgacggaaucaugauaaaggaaauaugcaucaaacucaaagucgaccgccuggguaauaucucaaaggcauga

SEQ ID NO: 6853 - RNA, 4332 nt, Artificial Sequence
  Cas9 variant
augauaaaacuccuguaucuagagaaacucaagcaauacaccaugaagaaaauucuaggccuggaccuaggcacaaguuccaucgggugggcccuggucaacgaagcagaaaacuccgacgaagucagcuccauaaucaaacugggcguaagagucaauccacuaacggucgacgaaaugcagaauuucgagaagggaaagagcaucaccaccaacgcagaccgcacacucaagcgcucaaugcgacgcaaucuccaaagauacaaacucagaagagacgcacuaauagaacuucuaaagaaaguaggcuucaucaccgacaagacaauccucagcgaacaggguaacaggaccaccuucgagacuuaccgacuccgugcgaaagcggccgaagaagagaucagccuaaaagaacuagcacgaguccuacuaaugaucaacaagaaacguggauacaaauccucacggaaggcgaaaggcgaagaagagggggcucucauagacgggauggagauagcgaaaaagcucuacgaugaggaccugacucccggccagcugugccugcagcuauuagaaucgggcaagaaauucuucccggacuucuaccgcucggaccugcaagaagaguucaacaaaauaugggacuuccagaagcaguuuaaccucuucagcuucugcgauguagcaaaagaggaggucaaagggaagaacaaaagccaaacaugggcgauccucgcgaaauacuucguagaaaccaagaaagugaacgucuggaacgaacacgaggcgcagacagaaaacagagaggaagucuacaaacugguaggacuaaaacgaaccgucaaaggggaggagcucaaaaaggagaacuaucgauggagaguacaagcgcuaacggaacaacuggaccuagagaaaaucgcuguagugcuacaagaaauuaacggccaaauuuccgccagcuccggauaucuuggagcaaucuccgaccggagcaagguccuguacuucaaccgucaaacggucggacaauaccaaauggccgagcucaacaaaaacccuaacaugucgcucagaaacauggucuucuaccgacaggacuaccucgacgaguucaacgucaucugggaaaagcaggccgaguuucauaaagagcuaaccccggaacucaagaaagagauacgagacaucaucauauucuaccaacggcggcucaaaucgcaaaaaggccuaauaucauucugcgaguucgaaaaccgagaggucgucguagaaaaagaaggaaagaaacaaaccaaaauaaucggcuguaaagucaucccacggagccauccccuguuccaagaguucaaaaucuggcaaacccugaacaacauagaaguauuugugggcgagaagaaaggaaaacgcaagaaaucaaacgucaguagcgaccucuucggggacacggaagacgcacugauaaccgaaggacgacgguuccuguaccaggaagaaaagaaaauacuggccaaagaacuaucaaucaagaaaggccuaaccaaagcagaaauacuccgccuccuuuucgaaaacccccaagagcuggacaucaacuucaaacaaaucgacggcaaccaaaccggguucgcccuauuuucggcguacaguaacaugaucgagaaauacggauacgaaccccucgacuuuaagaaacccgcggaggaccucauuucccaacuaaaaacuguuuuuacagaccugggcuggaacaccgaccuccuauucaucgaucuagacaaagaaaacaaagaaugggaaaaacaaccguacuucagauuguggcaucuucuauacaguuuugaaggggauaacaccccaacagggaauggcaaacucaucgagaaaaucaugcaacuaugcgguauagaaaaagaguacgcaaucgaacuagccaacgucagccugcaggacgacuacgggagccucucggcaaaagccauaaagaaaauacuccuguaccucaaagaaggcaaccaauaugacauggcaugcgaauacgcaggauaccgccacuccaaaagcucccuaacgaaagaagaaauagaaaacaaagugcuaaaggacaaauuagagauacuccccaaaaacucgcuacgaaacccagucguagagaaaauccugaaccagaugguuaacgucaucaacacagugauggaaguauacggcagaccggacgaaauacgcgucgaacucgcucgagaauugaagaaaagugcgaaagaacgagaggaacuaacgaaggccguagccaaaaacacccgcgaacacgaggagauacgcaaaguauugcagucagaguuuggcaugauaaauguuagccgcaaugacaucauaagauacaagcuguaugaggaacucaaagacaacgguuacaaaacguuauacaguaaccaauacaucccgcgggaaaagcuguucucgaaagaaaucgauaucgaacacaucaucccccagucccggcuguucgacgacuccuugagcaacaaaacccuggaauacaaaucaauuaacaucgaaaaaggaaacaagacagcauacgauuucguaaaagagaaguacggagaagagggccuacagcaguaccucaaccgcugcgaaaaccucugcaaagauaagaaagcaaaacucagaaaacuuaaaauggaacucaacgagauaccagacgguuucaucgauagagaccugcgaaacacucaguacauagccaagaaggcucugaguaugcucacagaaauaugccgacgcguaguggccaccaccggaagcaucacagacaaacuaagggaagauuggcagcuaguagacgucaugaaggagcuaaaccuacccaaauacgaggcgcuaggucugguggaggucuacgaagauaaagacgggaggaagaucaagcggauaaaagauuggaccaaacgcaacgaccaccgacaccacgccauggacgcccuaacggucgccuucaccaaagacgucuucauacaauacuucaauaacaaaaacgcagccugggaaagcgacagcaaagagcacacuaacauuguuggaaucaaaacucgcuacuucgaaucaggaaaagccgugcccccgaucccccugggccaauuccgcgucgaggccaaaugucaccuagaaaaccuccucguaucgauaaaagccaaaaauaaaguagugacgacaaacgucaacuguauaaagaagaaaggagguaccuacaaaaacacccaacagaccccacgcggacagcuccaccucgaaacgauauacggaagccacaaccaauaugucacuaagauagaaaagguaaacgcaucauucgacgccgugaaaaucgccaccgucagcaaacaggauuaccggaacgcgcuacuaaagcgccucgaaguauucgguaacgacccgaaaaaggccuuuacagguaagaacagccuugagaaaaacccgaucuaccuagauagggcacaaacgauacaagucccggauaagguccaaaccgucgaacucgaaacagcguacaccauuagaaaaccgguugacccaacacucaacguugacaaagugguagacaaaaagauccgacugauccucgaacaacggcugaaagaauauggcggagaugcaaagaaggcuuucgugaaccucgacgaaaaccccauauggcuaaacgaagaaaaaggcauaucgauaaaacggguuacgauccgcggcaucuccaaggcacaggcgcuccacgacaagaaagacaaagauggcaacuuuaucuuagacgaaaccgggaaaaggauaccgguugacuucgucaacacgggcaacaaccaccacguagcgaucuaccggaaacccguacuugacaagaaaggccaggucauauucgacgacgaagguaacccuauguacgaacuugacgaggacguaguccccuucuucgaggcaguaaccagagcgaaccucggcauccccaucauagacaaagacuacaagaaauccgaaggcuggcaguuccucuucuccaugaaacaaaacgaauacuucguauucccgaacgagaaaaccggguucaauccgaaagagguagaccuucucgaccccgacaacuacgcuaugauuagcccgaacuuauuccgcguccagaaaaucggacucaacgacuacacuuuucgacaccaccucgaaaccacaauacaaaaugaccucaaauucaucaccuggauaagguguggaaaaucaggcauaaaggacaucgugaaggucaggaucaaccacauaggacaaaucguaagcgucggugaguacuga

SEQ ID NO: 6854 - RNA, 4332 nt, Artificial Sequence
  Cas9 variant
augaaaaagauacuaggccucgaucuggguaccgccucuaucgggagcgcauaugugcucgaagcugagaagucggcagaucaaaccaaaaucgucuaccuugguacccgaauuauccucuccuccgcagacgccgagaacuucuccaaaggccucagcugcuccccaacgacugaccggacauuuaaaagauccaugcgucgcagacugcagcgauacaaacagaggcgcucaagccucauacaacaauucaagaaaauagguaucauaacaaacacagagcaaauuauccgugagccuaucucagaaacccacgaacuacuacgcauccgcagcaaagcaguaucggaacacgucucauuagaagaguucgcccguauucuccucacuaucaacaaaagacguggauacaaaucaaaccgcaagacuuccaaaucuaccgaagaagaugguaaacucguagacgccauggccgucacgaaggaguuaaucaaacuuaagaaaaccccaggacaauacauguucgaacgcuuuaaacguggcaaauacgcugaaaucgacuucuaccccuuugaccucaucaaugaacucaaacagaucugggaaguucaaggccaaaaauauccggacguacuaacggaaggccuucuuuccucccuauugaaacagaaaacaggaaaagcaaaggaacuaaucuacucaaaauccgaccuaaaucccgcggaagugccgauagauuaccagaaaggcaagaagcuccgcaagacaauacuaaacaaauauuucgcauacgaaucccgaucacucgccgucacaaauaucaucccaguggaacaagccauuacagcgaucgucgccauuugcaagcagauaaacaacuccagcggguaccuaggcgcgauaggcgaccgcagucgcguccucuaugccaacaaccaaaccaucggucaauaccuauacgagagaaucaaagcaaacccacacgaccgcauaagaggcgaaguauucuaccggcaagacuaccuagacgaguucgacagaauuugggagugccagcaaaacuacuacccagcaauucucacaaacgaccgaaagcaguacauccgcaaucggaucauauucuaucagcgcccccuaaagagcaagaaaucagagcuagcauucugugaguucgaaucccgcgagguagaacauaacgguaagaaauacacggaagggcuacacguugcaccgaaaaguuccccuguuuuccaacacuucagacucuggcagagacucggccagaucgaggugagcccacuccgaaaaugggauaaacaaucaaacgaacuguucgaacaacaaaacaacgccgaccgggagggcauacugaacaccgaggcaaagcaaaaacucuucuccuaccugaaccuccuagaccacuugacugauaacgagauccucaacauccucggauacagcccagacaaguggaaaauaaacuuccgcgagaucauaggcaaccgaaccaacaaccuuaugaugaaagccuucuucagcaugaaggaaaugaccgauggggagcaaauagacugggagaaaaaccuaaccaaaaucaccaacggccagagccugaucucaccagaacaaauaguagaccucauaaggcaauucuucgaacgcgaaggcaucaccacaucauuacuauacuucgaccccgccaccgauaauuuccgggagcagagccacuacucguuauggcaccuccuauacagcuaugaagacgacaacucgccaacaggcaccaccucccucugcaagacgcuagccaaacgguacggcaucccccaugaacuguguccccuguuagccagccuaacauucgagaggcaguacgguucacucuccaccaaagcaaugaggaaacugcucccguuuaugcaggaaaagcgcuacgaugaggcaugcgaacuagcuggguaucgccacucagcauggauuacgaaggaggaaaacgccaagaggacccucaagaacaaacucccacuccucagaaaagggucccuccggaauccagucguagagaaaauccugaaucaaaugacccacgugaucaauacccacaucgcggaauacggaaaucccgacgaaauccggauagaaauggcacgcgauaugcaagccaacuccaaacagagaaaggccaugacagcggccauaaccgaagccacgaaacgcaauacgcaguucaucgaagagauacagaaagaguucggcuucaacccauccaaaaacgaccuaauaaaguacaaacuauggaaagaacuagcaccccugggaaacaagacccucuacucaaacaucuacaucccgaaggaagaacuauucacagccaaauuugaaaucgaacacaucauaccacgcgcccucuucuacgacgacuccuuuaguaacaaaacccucgaauuaaacagcgucaacaaacugaaaggcaauaaaacugcacuagacuaccuagacacccucggacaagagaaagccaacgauuacauccuaagaguagaagaacugaagaaaaucggggcaauaacgcaagccaaauacaagaaacuccugauccgcgagaaagaccuaggagaugacuucaccaaccgcgaccuaaccaacacacgguacaucauccgccacgccgcggaccgcgaccugacaaacacacgcuacaucauccgacacgcggcagacaugcugcugcagguaacccccagcaucguccacaccaacggcuccauaaccgcaauccugagacgagacugggggcuccuggacauacucaaagaauuaaaccucccgacauacgaaagcauugaccgcaagauaucagacccagaagaaaaacucacacaauccguugaucgaaaagacggccaagcgauuaaaaugaucaaggacuggagcaaaagagaugaccaucgacaccacgcaauggacgcccucaucacagccuugacgacaagaaagcacguccaguaccuaaacgggaacucgggcgccgaagaaacggacaaagcgcaaaaacuugaacaacucaaagcucuccgcaagcaacugauuggcagcgacggacacuucaucccaccaaugcacgacauccgaguacaagcuaaagaagcccucuccagagucaucaucuccaccaaaguuaagggcaaagucacaaccccaaacacuaacaucauauguagcagagacaaaacaacaggcagaaaaauauacguccgccaaaccacucucacaccccgcggcgcauuacaccuagacaccaaauacggaaucaacagauacuaccaggagagggaggucucgauagguagcaagcucacccaggaagagauccggcucguauccuccccgcacauccaaucaauccuacucgaacgacuacgugccuucgacaacaacccgaagucagccuucacgggucgcaacucuguagauaagaaaccucucgaagacaaaaacaagaaacucgucuacaccgauaagaaagugaaacaaaccauacuugcaaaccgcuuuguaaagcgcgaccgagugaacuccaaacuggaccucgacaacguaauagacacgggcauaaaacgcauccucgaacgccgccucaaacaguacggaggaaaauaugaaacagccuucucagaccucgaaaacaaucccaucuggcucaacgaagaaaaagguaucgccaucaaaucuguccguauacgcgggaaaaacaacacaaucaccauccgccaaaccaacacaugccgaauaaaguacguggccaacgacaacaaccaccaccuagccgucuacgcacugccugacgggagcaucaaggacgacaucguaucauucuucgacgcaguagaaagaucccgcaaacgccuuccaauaaucgacaaacauaaaaaccaaucucuaggcuggaaguaucuauucagcaucaaacaaaacgaguacuuccuucuaccccaacaggucgagaaaauugacauagacacgggggagauuuccaugcaaacaaccuucucgccuaaagacuuaucccacgaauacauaaugaaucccgacaauuacgccgagcuugcaagccacauuuuccguguccagucaaucagcaaaaccccacagggaaacagagacguccgcaucuaccucuucaaacagcaauacaucucggguagccaaaaggacagccuacaccuuaaaggaauaacccacagacaaauuuccuccgccaaagaccuagccgagcugguaaaaauacgagugaaccaccucgggcgcaucguaucagucggagaaaaauga

SEQ ID NO: 6855 - RNA, 4341 nt, Artificial Sequence
  Cas9 variant
auggucaagaacauccugggccucgaccugggaacgaacagugugggcugggcccuaauuaaacaagacuuugagaacaaacaaggagacauccucggcaugggaucccggaucauccccaugucucaagacguccuaggcgacuucgggaagggcaauucuauaucgcagaccgcggaacggaccaaguacagaucggugagacgccugagggagcgcuuucucuugagacgagagcgccuccaccgaguacuaaacguccuagauuuucuaccggagcacuacgcaagccagaucgacuucaauaaaagauucggaaaauucaaagaggagaccgagccgaagcucgcguacucaaacgacggauucauauucaagaaaucuuuugaggaaaugaucucggacuucaagacccaucagcccgaacuccuagaaaacaauaagaaaguccccuacgacuggacaauauacuaccugcgaaauaaagcacucucgcauaaaaucgaaaaagaggaacuagcguggauccuacucaauuucaaccagaaaagaggauacuaccaacuacgcggugaagaagaagaagaaaacccaaacaaacugaucgaguucuacagccucaagauaguugacguacuagccgacgagccgcagaaaggcaaguccgacaucugguauagccucauacuugaaaauggauggaucuaccgucgauccuccaagaucccccuacucgauuggaaggguaaaacacgcgacuucaucgucacuacagaccuaaacgacgacggauccguaaagaccgacaaggagggcaaugaaaagcgaucuuuccgcgccccgggugaaaacgacuggacccucgucaaaaagaaaaccgaacaagaaaucgacaacuccgacaagacgguaggagcauauauauacgaagcucuccuacagaacccuaagcagaaaaucaaggguaagcucguacgcaccauagaacgaaaguucuauaaagcagagcuaaaacaaauccuagaaaagcaaauggaguuccaccccgaacuccgacaagacgaucucuauagcgacugcguccgcgagcucuauaaaaacaaugaagcccaucaacucaccuugucgaagaaagacuucguccaucuauucauggaagacaucaucuucuaucaaagaccacuccggucacagaaaagcucaaucucaaacuguacacuagaguuucggaaguacaaagacgagaacggaaccgaacacauucaauaccucaaggcacuccccaaguccaacccauacuaccaagaguuccgaauauggcaauggauguacaaccuaaacauauacaagaaagaggacgacacaaacgucaccaaagaauuucucaacuccaaagccgauuucgaaagccuauucgaguuccucaacaacaagaaagaaguggaccaaaaagcucuacucaagcacuucaaaaucaacgauaaaacucaccgauggaaauacguagaagacaagaaguaucccugcaacgaaacgaagaccaugauaagcgaacgauuaaagaaagucgagaacauauccgaugacuuuuuaacccgcgaaauggaacaaaagauauggcacaucauauacagcgucaacgacaagguaaaauacgaaaaagcgcucaagucauucgcugagaaaaacaaccucgacgaaucguccuuuuucgaagcauucaagaaauucccaccuuucaagucggaauacggagcguucuccgaaaaagcaaucaagaaacuacugccccuaaugcgccuaggaaaauacugggacgacgacgaaauccucaaauacagcgacauauacuucaaaaacaucgaguaccuucugggcgugcucaagcaaaaggacaaaaacauauccgacgacaacaggcaaaacuggaacaagucgaucaacaacaagcugcgagaagaacucgagauauuccaaaacgcggagaucgagucauuucaaggauuacgacuccacauagcacaauacauccuuuauggccgacacuccgaggccgcaaugcuaggcaaauggaacucggccgacgaccuagaggaauuucuaaaggaguucaagcaacacagccuaaggaauccuauagucgaacaaguaaucaccgagacccuccguguuguaaaggacaucugggucaaguacgggaacggcgccaaggacuucuucaacgaaauacacaucgaacucgggagggaaaugaaguugcccgcggaagaccgaaagaaaauuaccaaccaaauaagcgaaaacgagaacacaaaucuacgaaucaaggcuuuacuagccgaaaugaugguagauucgucuguugagaacguucgaccuuucagcccuaugcaacaagagauccugaaaaucuacgaggacggcguccucaacucggacaucgaaauagaggacgacauccugaagaucucuaaaaccgcacaacccagucccagcgaccucaagcgcuacaagcuauggcuagaacaaaaguacaaaucaccauauaccggccagaucauaccccuaaacaaacucuucacgccugaguacgagauugaacacauuaucccgcaaagccguuauuucgacgacucauucagcaacaaagucaucugcgaagcugcagugaacaaacuaaaggauaauuucaucggacuaggcuucauaaagcaauucggaggaaccaucgucgaaugcggcaacggcaaguccguuacagugcuaaaggaagaccaauacgaagacuucgucaagaaacacuacgccaauaaccgauccaaacgaaacaaacucuuacucgaagacaucccagaaaagaugauagagcgccaaaugaacgacacacgguacaucagcaaguacaucaguggaguccuaagcaacaucgucagaacagaggacggcacagacgacggcguuaacuccaaaaacauagucccaggcaacggaaagaucacgaauacgcugaaacaggacuggggcuuaaacgacauauggaacgaccucauccuaccgagguucgaacgcaugaaucaguugacaaacagcacagacuucaccgccuggaacgaaaaccaucagaaauucuuacccacagucccaguggaguucagcaaaggauucuccaagaaacgcauugaccaccgccaccacgcgcucgacgcccugguaauagcaugugcaaccaaagaccacgucaaccuccucaauaaccaauccgcaaaauccgacacgaaaagacacgaucugaaacgaaagcucaugaaauucgaaaaggucgccuacaaccacccacaaaccggcgagcgcaucgaacgcgaagucccaaaacaauuccuaaagcccugggaaacauucaccguugaggcaaagaauggauuggaaaccaucaucgucucguucaaacaaaaccuccgagugaucaacaaagccacgaaccauuacgagaaauacguagaaaaagacggcgccaaagucaaaggacgcgucgagcaagcaggaacgaacugggcgauucgcaagccgaugcauaaagaaaccguauccggaaaaauagacuugccgcgaaucaaagugcccaaagguaaaauccucacggccacgcggaaaaaccucgacacuagcuucgaccucaaaacaaucggaagcaucacagacaccgggauacagaaaauccucaaaaauuaccuacaguacaaggacaacaacccagaauuagccuucucaccagaaggaaucgaagacaugaacaaaaacauagagaaauucaacgacggcaaaguccaccagcccauaaucaaaguucggauauucgagcucggcuccaaauucccccucggccaaagcggcaacaaaaaggacaaguacgucgaagccgcaaaaggcacuaacuuauucuucgccguauaugaggacaaaaacggaaagagaucauacgagaccaucccacugaacgaaguuaucgaacgacaaaaacaaggacugacuguuguggaccugaaaggagugaacgacuucuaccuaucccccaacgaccugguguacgucccaagcgaagacgagcuagagaacgucuccaugaucgacuacaacaagcuaucgaacgaaaagguguacaaaguagucaguuucaccgguaaccaaauauucuucguccgacaggacgucgccaccaguauaguaaacaaggccgaguucagcucacuuaacaagauggagcgggccaucgggggaaccaugauuaaagagguauucguaaaaauaaaaauagaccgccucggcaauaucagcaaggucuga

SEQ ID NO: 6856 - RNA, 4347 nt, Artificial Sequence
  Cas9 variant
augaaacacauccuggggcuagaccugggaacaaacuccauaggcugggccguaguaaaagaggcccaaaacgacaaugaacaaagcgaaauagucgacgucggaguucgcguaaauccccugaccaccgaugagaagacaaacuucgagaaggggaaaccaaucagcacgaaugcagacaggacucucaaacgauccgcccgccgcaaucugcaaagauacaaacugcgacgcaaagaacuaaucgaacuacucaaagaacaccagcugauaucagagaacaccauacucacggaaaacggaaagggcacaacauuccagacccuagagcuacgugccaagagcgcgaaagagaaaaucucacucggcgaguuagcccgcguuuuccucacaaucaauaaaaagagaggcuacaaauccagcaggaaggccaaaaacggagacgagggacaacuuaucgacggaauggagaucgcgaagcgacuauacgaagagaaccucacgacuggacagcuuucgcuccagcuccuaaaggaaggaaagaaaucacuaccggacuacuacagaucagaccuacaguucgaacuagacaaggucuggaacuuccaaaagcagagucacuccgauauacucacggacgaguucuacgcacaacucaaaggcaaagggcaacgcgcuacuagcgcccucuuccuggcgaaauaucagaucuacacggcugaaaacaaaggaucccgagaggacaagaaacuacaagccuaccaauggcgagucgacgcccuauccaaggaacugacccgcgaagaacucgcguucgucaucaccgaaaucaacaacaaccuaaacaacucaagcgguuaccucggagcaaucagugaccgcucgaaagaacucuacuucaacaaugagaccguaggcgaauaccucuggaaacagaucgccgcgaauccccacaacucacugaaaaaccaaguguucuaucggcaagacuaccuagacgaguucgaacaaaucuggaagacgcaaucagcuuucuaccccgaaauccuuacagacgaacugaagaaagagcuacgggacguugucauauuuuaccaaagaaaacuaaaaucccaaaaaucccuagucagcuuuugugaguucgaaaacaaggaaaucgaaauaaagaacgaggacggaaccaccacgaagaaagugaucggccucaaaguggcccccaaauccagcccccuauuccaagaguucaaaaucuggcaaaaccucaacaauguccuaauccgcaaaaagggcucaaaaacaaagaaagucgccaaaaaucaacaagcgguauuauucgaagaagagaaaaccauaucugaauuagaccuugaagcgaaacaggcacucuucaacgaacugaaccucaaaggaaaccucaaagccgacuacugccuagaaauccuaggguacucaccgaaagaaugggaaaugaacuacuccauucucgaaggaaaccgcacaaacaaagcacuauaugaggccuaccuaaaaaucacggaccuggagggguacgacgcaaagaaccaccuaaaagugaaacuuaacaaggaugaaguagagcucgacgaccucaaagugccagccucagaaaucaaggacaugguccaggcuaucuuuaaagaggcaggaauuaacacugacauacugcacuucaacgcagaacucgacgggaaagacuucgagaaccaagcaagcuaucaauuguggcaccuacuuuacucauacgaaggcgacgacagcaagucgggcaacgagcuucucuacaaacuauuggagaccaaauucggcuucaaaaaggaguacgcacaaauuuuggcgaauguuagccucucggacgacuacggaaaucucaguacaaaagcuaugcgggagauuauaacccaccucaaacagggguuccccuucacaggccgcaaggaccgcccggacgagccauccgcgugcgaguucgcgggcuauaaacacuccaaacacucgcuaacgaaagaagaaaaugagaagcgcguccugaaggauagccuggagguacucaaaaagaacagccugcgccaacccgucgucgaaaagauccugaaccaaaugaucaaccuggucaacgcgcugcugaagaaauaccggacagagaauccaaacuucaaauucgacgagauacgcaucgaacuagcgagagagcucaaaaagaaggccgaggaacgcgcuaacaugaccgcgaauaucaacaaggcuaaaacggagcacgagaaaaucauaaaaauacuaaagaaugaguucggacuaccaaacccgacgcggaacgacauuauacgcuaccgccuguacgaagaauuaaaggauaacggauacaaagaccuauauaagggcgacuacaucccccgggaaaaacucuucaguaaagaaauagacauagaacacaucauccccaaagcccgaguguucgacgacagcuucuccaacaagacaauaaccuacaggaagacaaacuuggaaaagggcgaacgcacugcguaugacuacaucgagucccuuggcgaaaagcaacuagaggaguuccuaagccgcauagaaaaccuauacgaaaucgggaaacccucgcgccuccacaacagacgaaauccccuaaagaaaguggaggaaaaaggcaucagcgacaguaaauacaagaaacuccugaagaaagagagcgaaaucggcgacggguucgucgagcgugaucuacgggaaacacaauacaucgccaagaaagccaaagagauccuacuucagauaacgcgcagcgugcucuccacuagcgggggcaucaccgaucgccuccgcgaagauugggaccuaaucaaugugaugaaagaacucaaccugccaaaauacagagcccucggccugacgaaaauggaggaucguaaauacggccaacaggucgaggucauaacagacuggacaaaacgaaacgaccuccgccaccacgcaauggaugcacuaacaguagcauucaccaaacacaaucacauccaauaccuaaacuaccucaaugcgcggaaaaacgaaaaacauaaagaacacaacaauauaauggccauacaacaacuagaaacaaucaaagucacggacgaaaacggcaacgaaaaacguauauucaaagcgcccaugccuaacuuccgacagguggccaaagcauuccucgaaaacguacucauaucgcacaaagccaaaaacaaaguaguaaccaaaaacaagaacaagaucuccggcaacaacaaaguacaagaagugcucacaccgcgcggacaacuacauaaagagacaauuuacggaaaauaccaguacuacguacagaaagaggagaaaaucggcgguaaauuugaucuggaaaccauagaaaaaguagccaacccccuguaccaaagccuuuugaagaaacgucucgaagaaaacggcggcgacccaaagaaagcguucaccggcaaaaacagccucgcuaaaaacccgaucuaccucgacgaagcacaaaccgaacagcuaccggaaaaaguaaaacugguauggcucgaaaacucauucuccauuaggaaagacaucacaccggagaacuucaaagacgagaaacugaucgacaaaauacucgacgaaggcgucaaacggauacuaaaagagcgguuacaguccuucggcaacgacgcgaagaaagccuucagcgacuuagagaaaaacccgauauggcugaacaaagaaaaagguauagccauaaaaagaguaacaaucuccggcguagcaaaugcagaaccgcuacacacgaagaaagaccaccucggaaaagaaauccucgacaaagaggguaaacccauccccgucgauuuuaucagcaccggauccaaccaccacguagcagucuaucgcgacgaaaaaggaaaccuccaagagaagguagugaguguauucgaagcagucguacgagcgaaccaaggccucccaaucauugacaagacauacaaucaauaccucggcugggaguuccuauucagcaugaaacagaacgagauguucguguuccccaaugagucaacuggcuucaacccgaacgacaucgaucuacuggaccccaagaacaagaaaauaauaagccccaaccucuuuagaguccaaaaacuggcgacaggcgacuacugguuccgacaccaccuagagaccacugucgagacaaaaagcgcaacgaaagauaugacguacaaaagacucagccucaaccacaucaaaaacauaaucaaaguccggauaaaccaccuaggcgauaucgugagcgugggagaauacuga

SEQ ID NO: 6857 - RNA, 4353 nt, Artificial Sequence
  Cas9 variant
augaaacacauccuggggcuugaucucggaagcaacuccauaggaugggcuuucguccagcaggacuuugagaacaaacaaggcaagauaaucgcaaccgggucccgcauaauccccauggaccaggggauacucggugacuucgaacgaggcaauacuguaagccaaacagccgaacgaacgaccuaucggaacacccggcgacuccgagaacgccaccuacuccgccgggaacgauuacacagaguacuacacauccuaggcuuccucccuccccacuacgacagccagaucgacuucaccaaaagauacggcaaauucaucgacaacgccgaaccaaaaauugcuuauaacaacggaaacuucauuuucaugaacucguuuaacgaaaugauugaggacuucaagaaauaccagccacaacuguucuacaagaaaucaaacggcgaagaaucuaaaaucccauacgacuggacaaucuacuaccuccgcaagaaagccuuaucccagaaaauaacccaacaagaacuugccuggcuaauacuccacuucaaccaaaaacgcggauacuaccagcuacgcggcgaggaagagaccgagaacccaaacaaagagguggccuuccacucccucgaggucguagauguagaagccgaggccccaaacaagaaaggagagauaugguacaccauccggcucgagaacggcuggauauaccgaagaaccagcaaaaucccccucgacgacuggaaaggcaaaaccagagacuucauagucacaacagaccucaacgacgacgggacgauaaaacucgacaaggagggcaaagaaaagcguucguuccgagccccggaugaaaacgacuggaaccuccucaaaaagaagacagaacacgacaucgacuucucagggaaaacagugggagcauauauuuacgaccaucuacuacaaaaccccaaccagaaaauaaaagggaagcuaguccgcaccauagaaagaaaguauuauaaagacgaacuaaaagccauacuagccaaacagaucgcgcuacagcccgaauuauucacggaaacgcuccucgcagacugcauucgagaacuauaccgcaaaaacgaaacccaacagcagaaccuccucucgaaagacuuccuccaccuguucgucgaagacauaauauucuaccagcgcccacuacgcucgaaaaaguccacaaucgcgaacuguacccuugaaaagcgcuccuacauagacaaggaaaccaacgagcgaaaagacacgcccauaaaaguaugugcgaaaucaaacccguauuaccaagaguuccgcguccuccaguggcuccagaaccugcgcaucuacgaaaucgagaccgacagggaggucacugcagaguucauugaaaccgcccaagacaacgaggcccucuucaacuuccucaugucccagaaagaaaucgacaaugaaagucuccucaaauacuuccucuuugccaaaaauccgcaaauaaaggacaaggucgcgaaauccgaacuaaagaaguggcugacaacauaccgguggaacuacguguaugacgcggcagauaacaguagcaagaaauaccccaugaacgaaaccggcuacgagcuccagcaauaccuacaaaaaguggaaggacuaccugcaaacuuccuaacguuugacaucacauacagacuguggcaccuacuuuacuccguaaaagacaaaguggaguucgaaaaagcccuuaagaaauucgcgcaagaauaccaacuggacgaagcgucauuuguugacucauucaagaacuucaaacccuacccgaaugaauacggguccuuuagcgaaaaagccaucaagaaacuccuaccacucaugcgcuucggaaaccauugggacuuuaauaggauagacguaucaacccaaaaacggauagacgaccuaaucaacggcguagccaaugacgaaaucagaacaauaauacgcgagaaggccgaaaaauaucaacugaacagcgaaacaugcuuccaaggccuaccccuauggcucgcacaauacgugguguacaauagacacgcagaagccgcugacaucgaaaaguggacaagcgucaacgaccucgaagcauaucuagaagacuucaaacaacacagccucagaaacccaaucguagaacaagucaucacagaaacgcugagagucgugcgagacauuuggcaacgauacggcggcggccaggcaaacuucuucgacgagauacacaucgaguuaggacgagaacuaaagaaaacagcggaggaaagaaaacaacugagcaaccgcaaccaggaaaaugagaacacgaaucuucguaucaaaaagcuccucgccgaacugaaagaggacgcgagcauacaaaacguaaggccuuacagcccgguccaacaggaauuacugaaaaucuacgaggaaggagucuucagcgccaccgacgaaguggaagaagauauccagaaaaucaggaaaaaggcagaaccgacaacccccgagauccaacgauacaaacuguggcuugagcaaaaauauaaaagucccuacacaggagaaguuaucucccuaaccaaacucuuuacggaggaguacgagauugaacacaucaucccacagagccgauacuaugacgacucccuaucaaacaaagugauaugugaaagcgcugugaacaaacugaaaaccaaucagcugggccuagaguucauccaaaaccaccacggcgaaaagguccgcaucaccgccaacaaggagguuaccauauucaccgaagaacaauacaaggaguucgugaagaaacacuacgcgaacaacuccgcgaaacaacaaaaacuccuacucaacgaaaucccugaaaagauggucgccagacaacucaacgacacgcgcuacaucagcaaauacaucagcgaaauacuaucaaaaauaguccggagcgacgaaaaagaugaaggcguaaacagcaaaaacaucauccccugcaccggcaaaaucacaaccgcacuaaaacaggacuggggacugaacgacguuuggaacgaacuaauccucccacgauucgagcggaugaaucaacuuacgcagacucagcuguucaccucauacaacgacagauuccagaaaaaccuaccaacugucccaauugaauacucacaaggauuccagaaaaagcgcauagaccaccgccaccacgcgauggacgcucuggugaucgcaugcgcaacccgcgaacacaucaacuacaugaacaaccaacaugcccuagacaaaagcaaggacaagaaagaaaaacaacaaagucgcauagacuugcgcaccauccucugcgaaaagaagaauaacaacuggcaguucaagaaaccauggucaacauucacacaagaagcgcaggaggcacucgaacacauuguaguauccuuuaaacaaaaccuacgcguaauaaauaaagccaccaacuauuacgaaaaaugggaagagaaaaauggcgugcuagucaaaaagaaagugaaacaggagggcaccaacugggcaauccgaaaaccacugcacaaagagaccguaaguggcaaaauaguccucgaccguaaaauuggcaaagacaagauccucacagcuacccgaaaaucaguugauaucacauucacugagaaaaucauaagcuccauaaccgauacuggcauacaaaagauacugcucaacuaccucaaauacaaagggucgcccgaagucgccuuuagcgcagaaggccuggaagaacugaacaagaacauagcucaauacaaugacggaaagaaacaucaaccgaucuauaaaguacgcauauucgaagaagggucgaaauuuccccuaggagaaacaggagcaaaagcuaccaaauacgucgaagccgccaaagggaccaacuuauucuucggggucuaccaagggaaaggaaaacgaacauacgccaccaucccacuaaacgaagucauugaacggcaaaagcaaggccugccaagcgugccagaacgcaacgaaaagggcgagccccuccuguucagccucucuccaaacgaucugguauacguaccgauggaaggcgaaaucgcggaaaccauugacuucaacaaccuaucuaaggagcaaaaggagagaaucuacaaaaccguauccuuuaccgggaaucaaugcuucuucguacaagaagccgucgccacgccaauagucaacaaaauagaauacagcccccucaacaaaauggaacgagacauccucggaacgaugauaaaggaaguaugcauaaaacucaagguugaccgccucggcaauaucacgaaagccuga

SEQ ID NO: 6858 - RNA, 4353 nt, Artificial Sequence
  Cas9 variant
augaaacgcauccucggacucgaccucggaucaaacagcaucggaugggcguucgucgaacaggacuucgagaacaagcagggcaagaucauagccaccggcucccgcauaauaccaauggaccaaggcauacucggggacuucgagaaagggaauaccgucucccaaacggcggaacgaacaacauacaggagcaugagacggcuucgggaaagacaccuccugcggcgcgaaagacuacaccgcgugcugcacauacucggguuccugcccccgcacuaugacgcgcaaauugacuucacaaaaagauacggcaaauucaucgacaacgcugagccgaagaucgcauacaacaacggaaacuucauauucaugaacagcuuuaacgagaugauagaagacuucaagaaauaccaaccacaacuauucuacaaaaagucaaacggggaggagucgaaaaucccauacgacuggaccauauacuaccucagaaagaaaguacucagccagaaaauaacccagcaagagcucgcuuggcuaaucuuacacuucaaccaaaaacggggcuacuaccaacucagaggagaggaagagacggaaaacccaaacaaagaaguagccuuccauucacucaagguggucgacguagaagccgaggcgcccaacaagaaaggagagaucugguacacuauacggcuggaaaacgguuggauuuaccgacgaacgaguaagaucccccuagacgacuggaaaggcaagacaagagacuucauaguaaccaccgaccuuaacgacgauggcaccauaaaaguagacaaagagggaaaggaaaaacgaucauuccgcgcaccagacgaaaaugacuggaaccuccuaaagaagaaaacggagcacgacaucgauuucuccggcaaaacagugggagccuacauauaugaccacuugcuucaaaacccaaaccagaaaaucaaaggcaaacucguacggaccaucgaacgcaaguacuacaaagacgagcuaaaggccauccucgccaaacaaauagcccuccaaccagaacucuucaccgagacgcuccucgcggacugcaucagagaacucuaccggaaaaacgaaacccaacaacaaaaccugcuuagcaaagauuuccuacaccuauucguagaggacauaaucuucuaccaacgaccccugagaucuaagaaaagcaccauagccaauugcacacucgagaagcgaagcuacauagacaaggaaacaaacgaacgcaaggacaccuucauuaaggugugcgccaaaucuaacccguacuaccaagaguucaggguccugcaauggcugcaaaaccugagaauuuaugaaauagaaacagacagggaggucaccgccgaguucaucgaaacggcagaagacuacgaggcacuauucaacuuccuaaugagccaaaaagaaauagacaaugaagggcuacucaaauacuuccuuuucgcaaagaauccgcaaaucaaggacaaggucgcgaaaagcgaacucaaaaaguggcucacaacauauagauggaacuacguauacgacgccgccgacaacaguucgaagaaauacccgaugaaugaaacaggguaugaccuacagagauaucuacaaaaagucgaaggccuaccggcgaacuuccugaccuucgacaucaccuaccggcuguggcaccuccuauauuccgucaaagauaagguggaguucgaaaaggcucucaagaaguucgcccaggaguaccaacucgacgaagcgucguucguagauuccuucaaaaacuucaagccauaccccaaugaguacggcagcuucucggaaaaggccaucaagaaacuucugccccucaugcgauucggcaaccacugggauuuuaaccgaaucgacgucuccacccagaaacguauagacgaccuaaucaacggagucgccaacgacgagauacgaacgaucauaagagaaaaggccgagaaauaccaacuaaacucagaaucuugcuuccaggggcugcccuuguggcucgcccaauacgucgucuacaaccgacacgcagaagcaaccgauaucgaaaaauggaccagcgucagcgaucucgaaacauaccucgaggacuucaaacaacacucgcuacggaauccaaucgucgaacaagucgugaccgaaacgcuucggguggucagggacaucuggcaacaguacggaggcggccaagcgaacuucuucgaugaaauccacaucgaacuagggcgcgaguugaaaaagacugccgaagaacgcaaacaacucagcaaccgcaaccaagaaaaugaaaacaccaaucuccgaaucaaaaagcucuuggccgaacugaaggaagacgcaaguauacagaacgucagacccuacagccccguccaacaagaacuccugaaaaucuacgaggaaggcguauucagcuccacagaccaaguggaggaggauauacagaaaauucgcaagaaagccgaaccaacaacuccggagauccaacgauacaaacuguggcucgagcaaaaauacaaaucaccguacaccggcgagguaauuagccugaccaagcuauucacggaagaauacgaaaucgagcacaucaucccacaaucuagauacuacgacgacagucuaagcaacaaagucaucugcgagucagccguaaacaaacucaaaacuaaccaacuaggccuggaguucauccaaaaccaccacggcgaaaaaguccgaauaacgggcaacaaagaaguuacaauauucaccgaggaacaguacaaagaauuugucaaaaagcacuacgcgaacaacuccgcaaaacaacaaaagcuccuccugaacgaaaucccagagaagauggucgcacgccagcucaacgacacccgcuacaucucgaaauacaucucagagauucuaucaaaaauaguacgaagugacgaaaaagacgagggcgucaacagcaaaaacgucaucccaugcaccggcaagaucaccacagcccuuaagcaagauuggggccucaacgacguauggaacgaacucauacugccacgguucgagcgcaugaaccaacuaacucaaacccaacuauucaccucauacaacgaucgcuuccagaaaaaucuuccgacaguccccaucgaguacagccaaggauuucaaaagaaacgaaucgaccaccgacaucacgccauggacgcacucgugaucgccugcgccacccgagaacacaucaacuacaugaacaaucaacacgcccucgacaaaaacaaggacaaaaaggaaaaacaacaaucgcgcauagacuugaggacaauucuaugcgagaagaaaaacaacaacuggcaauucaagaaaccauggaguacauucacccaagagacaaaagaagcacucgaacacauagucgugagcuucaaacaaaaccugcgggucaucaauaaagccaccaacuacuaugaaaaaugggaagagaaaaacggcguccuagugaaaaagaagguaaaacaagaaggcacgaacugggcuauaagaaaaccacuccacaaagaaacaguuagcgggaagauuguauuagaccgaaaaaucggaaaagacaagauccuuacggcgacccgcaaggaaguagacauaacauuuaccgagaaaaucaucuccagcaucacagacacaggaauccagaaaauccuacuaaauuaccucaacuacaagggcucccccgaaguagccuucucagccgaaggacuagaagaacucaacaaaaacauagcccaauacaacgacgggaaaaagcaccaacccaucuacaaggucagaaucuucgaggagggaaguaaguucccauuaggagaaacgggcgcaaaagcuaccaaauucguagaagcagccaaaggaacaaaccucuucuucggaguauaccaggggaaagaaaaacgauccuacgcaacuauaccucuaaacgaggucaucgaacgccagaaacaaggacugccaagcguaccagagcgcaacgaaaagggcgagccacuccucuucagccuguccccgaacgaccucgucuacguccccauggaaggcgaaauagccgagacgauagacuucaacaaccuuuccaaggaacagaaggagcgaaucuacaaaacggugagcuucaccggcaaccagugcuucuucguccaagaagcggucgccacgccaauuguaaacaaaauggaauacuccccacuuaacaaaauggaacgcgacauccuugggaccaugaucaaagagguaugcaucaaacuaaaaguagacaggcucggaaauauaacaaaagcuuga

SEQ ID NO: 6859 - RNA, 4353 nt, Artificial Sequence
  Cas9 variant
augaaacacauccuaggucuagaccucggcucaaacagcaucggcugggccuuuguacagcaggacuucgaaaauaaacaaggcaaaaucauagcagcgggcagccgaauaaucccaauggaccagaaaaugcucuccaacuucgaagagggcaccacaguaagccaaacagcagaaagaaccacauaccgcagcaugcggagacucagagaacgacaccuacuccgaagagaacgacuccaccgaguccuucacauccucggcuuucuaccgccccacuacgacgcucaaauugacuucacgaaacgauacggaaaauucaucgacaacgcggaacccaaaauagccuacaauaacgggaacuuuaucuucaugaauagcuucaacgagaugauagaagacuucaaggaacaccagccccagcuauuuuacaagaaaagcaacggcgaggaaucaaaaauacccuaugauuggacaauauacuaccuccgaaagaaagcccucagccaaaagauuacacagcaagagcucgccuggcuaauacuccacuucaaccaaaaacgaggauacuaucagcucagaggagaagaagaaacagaaaauccaaacaaagagguagccuuccauagccuaaagguaguggaugucgaagccgaagccccaaauaagaaaggcgaaauaugguacacgauccgccucgagaauggguggauauacagacgaacauccaaaaucccguuggacgacuggaaagggaaaacccgcgacuucaucguuaccaccgacuugaacgacgacgggacgaucaaacuugacaaagaaggaaaagaaaaacguucauuccgcgccccagacgaaaacgacuggaaccuccugaagaagaaaacagaacacgacauagacuuuuccgggaagccagucgggacuuacauuuacgaucaccuacugcagaacccaaaucagaaaauaaaggggaaacucguacggaccaucgagcgcaaguacuacaaagacgaacugaaagccauccucgcgaagcaaauagcacuacaacccgaacuguucaccgagacccuacuagcggauugcaucagggaacuauaccgaaagaacgagacacagcaacaaaaccuccucucaaaagacuuucuccacuuauucgucgaggacaucauauucuaccagagaccucuucgaagcaagaaaucaacuauagcuaacugcacgcucgaaaaacgcucuuacaucgacaaagaaaccaaugaacgcaaagacacccccauuaaagucugcucgaaaucgaacccauacuaccaagaguuccggguccuacaguggcuccaaaaccucagaaucuacgaaauagaaacugaccgcgaagucaccgccgaguucaucgaaaccgcucaggacuacgaagcacuguucaacuuccugaugucacagaaagagaucgacaacgagagccuacucaaguacuuccucuucgccaaaaacccucaaauaaaagauaaaaccgcaaaaaucgaacuuaagaaauggaucacgacauaccgcuggaauuacgucuacgacguagccgacaacucuucaaagaaauaucccaugaacgagacgggauacgaccugcaaagguauaugcaaaaaguagaagggcuucccaccaauuuccucacguucgacaccaccuauagguuauggcaccuucuguacagcguuaaagacaaaguagaguucgaaaaagcgcucaaaaaguucgccaaaaagaaacaacuagacaaaaccagcuucgucgacagcuucaaaaacuucaaacccuaccccaacgaauacggcuccuucuccgagaaagcaaucaagaaacuacuaccccuaaugcgcuucgggaaccacugggacuucaaccgaauagauguauccacgcagaaacgcauagacgaccugauaaacggagucgccaacgaagacauccggaccauuauccgcgagaaagccgaaaaauaccagcuuaauuccgaaaccugcuuccaggaucucccccucuggcuagcgcaguacguagucuacaaccgucacgcugaggccacugacaucgagaaauggaccagcguuucugaccucgaagccuaucucgaagauuucaaacaacacucccugcgaaacccaauagucgaacaagucgugacggagacccuccgcguuguacgagauauauggcagcaauacggaggaggacaggccaacuucuucgaugaaauacacauagagcucggacgcgaacugaaaaagacggcagaagaacguaaacaacuauccgacaagaaccaggaaaaugaaaacaccaaucuaaggauaaagaaacuccuagccgaacucaaagaggacgccuccauccaaaacguccggcccuacucccuuguucaacaagaauuacuuaaaaucuaugaagagggcgucuucuccagcaccgaugaaauagaggaggacauccagaaaauacgcaagaaaguagagcccacaaccccagagauccaacgauacaagcucuggcuugaacaaaaguacaagaguccauauacgggggaggucauaucccuaacaaaacuguucaccgaagaauacgaaauagaacacaucaucccacaaucaagauacuacgacgacagccucucaaacaaggucauaugcgaguccgccguaaacaaacuaaaaacaaaccaacugggccucgaguucauacaaaaccaccacggggaaaagguucgaaucacggccaacaaggaagugacaauauucacagaagaacaauacaaagaguucguaaagaaacacuacgcaaacaacagcgcaaaacagcaaaaacuacucuuaaacgaaauccccgagaaaaugguagcgcgacagcuaaacgacacucgguacaucuccaaauacaucagcgagauccugucaaaaauaguccgaucagaugagaaagacgaggggguuaacuccaaaaacaucauacccugcaccgggaaaaucacaaccgcacuaaaacaggacuggggccucaaugacgucuggaaugagcugauucuaccacgauucgaacgcaugaaccaacugacacaaacacagcuauucacaucguacaacgaccgacuacagaaaaaucuaccaacaguacccauugaauauucacaaggcuuccaaaagaaacgcaucgaccaucgacaccacgcgauggacgcccucgucaucgccugcgccaccagagagcacauaaacuauaugaacaaccagcacgcccucgacaaaucaaaagacaagaaagaaaaacaacagucacggaucgaucucagaaccauacugugcgaaaagaaaaauaauaauuggcaauucaagaaaccauggcgaaccuucacacaagaggcuaaagaggcgcucgagcacaucgucgucucuuucaaacaaaaccucaggguuauaaauaaagccaccaauuacuacgaaaaaugggaagagaaaaacgguguacucgucaaaaagaaagugaagcaggaaggcacaaacugggcaauacgcaaaccccuacacgaggagaccuucaguggaaagauaagccuaaaccgagagaaagucggaaaggggaacaucuuaacagccacacgcaaggcgguggacagcucauucgaugugaaaaagaucuccaaaauaacagacaccggcauacagaaaauucuacuaaacuaccucaaauacaagggauccccagagguggcauucuccgcagaagggcucgaggaacucaacaaaaacaucgcccaguacaacaacgggaaaaagcaccaaccuaucuacaagguccggaucuacgagaagggcucuggacgcuucguacuaggggaaaaagggacaaagagcaagaaauacgugcagggcgcgccaaaccuuuacuucggagucuaccaagguaaagagaaaaggacguacgccaccaucccacuuaacgaaguaaucgaacgacagaaacaaggucuaccaagcguaccggagagaaacgaaaaaggugaaccccuacuauucagccugucgccaaacgaccuggucuaugucccaauggaaggagaggccacugaaacgauuaacuucaacaaccugaacaaagaacagaaagaacgaauauacaagacggugagcuucacuggaaaccaaugcuucuuuguccaagaagccguagcaucacccaucgucaacaaaauggaguauucaccacugaacaaaauggaacgcagcaucguagggauuaugaucaaggaagucugcauaaaauuaaaagucgacagacucggaaacauaacaaaggccuga

SEQ ID NO: 6860 - RNA, 4362 nt, Artificial Sequence
  Cas9 variant
augaaaaccguacuuggcuuagaucucggcacgaacagcaucgggugggcacugauacagcacgacuucgauucuaagaaaggcgaaaucuuaggcauggggucccgcauaaucccaaugucccaggacauccugggagaguucggaaaagguaacucagucagccaaaccgcggaccggacaaaauuccgaagcgcgcgcagacuacgagaaagacaccuacucaggcgagaacgacuccacagaguucuuaacauacucggcuuccuaccacgacacuaugcagcggacauagacuucgagaaacgccucggccaguucuucgaagggaaggagcccaagcucgcuuacgacaacaaccaauucaucuucaccaaaucuuucgggaaaaugcucgcagacuuucgucaacaccagcccgauuuccucaaggacgagaaaaguaacgaccugcugauacccuacgacuggagcaucuacuaccuccggaaagaagcccucacgaagaaaaucgaaaaagaagaacuggccuggaucauccugaacuuuaaccaaaaacggggguacuaccagcuccgcggagaagaagaagaagagaaccucaacaaacuuguggaguuccacagccucaaaaucaucgacgugguggccgacgaaaagcucaacaacaaaggagaaacaugguauucacuucuacucgagaacggcuggacauaccgucgaucauccaaggugccacucuucgacuggaaagagaaaguccgcgacuucauaguuaccacagacaucaacgacgacggcagcgucaaaacagacaaagaggggaacgaaaaacgcucauuccgagcccccuccgaugacgauuggacgcugcucaaaaagaaaaccgagcaggauaucgacaagagucggaaacccaucggcgccuauauuuacgacgcaauccugaaaaauccaaaacagaaaaucaacgggaagcuaguucgcacaguugaaagaaaauucuacaaagaggaacuaaagcuaauuuuacagaagcagaaagaguuccaccccgaacuccaauccaccgaccuauacaacgaaugcauacgagagcucuauaaaaacaacgacgcacaccagcuacaacucaacaagaaagacuucguacaccuauucuuagaagacaucauauucuaccaacgcccauugcguucacagaaaagcucaguaggaaacugcccccuagaguucagaaaauuuaaagacagcgaaggaaucgagaaaguagaguaccucaaaacuaucccuaagucaaauccauacuuucaggaguuccggaucuggcaauggauguacaaccugaguauauacaagaaggacgaugacgaaaacgucacgagagacuuccuaaaaacgauagaagacugggaagaccuguucgaguuccucaaccauaggaaagacauagaacaagaaacgcuacucaaauuccuacuaggcaaaaacgggguaaaagggaaggcacugaaaguagaggcaggaaaauuucgguggaacuaugucucagauaaaauauacccaugcaacgaaaccaaagcacuaaucaucagcaagcuagagaaagugaagggggucgaggaaaaguuccugacagaggaaaucgaauacaagcucuggcaccugauauacuccgugacagacaaggucgaauacgagaaggcacuaaaggcauucgccgguaagcaaaaacuugaccuagugagcuucguagacuccuucaagcgguuuccgccauucaaaaacgaauacggggccuacagcgaaaaagcuaucaagaaaaucuugccccuacucaggacggggaaauccuggaacuggauggcaauagacucgaaaguccgugaccgcauuaacaaaaucaucaccggcgaguucgacgaagaaaucaaaaacaaaguccgagaaaaagcagaaaaacacucccucaagaaagaaaacgacuuucagggguugccacuguggcuagcacaauacgucgucuacgggagacacucagaggcgucauucucgggaaaauggaacucagucgacgaccuuaaaaaguaucuagaagaguuuaagcaacacucucuaagaaacccaauaguagaacaaguccuaacagaaacacugcgcguaguggcggacauauggcaauucuacgguaaaggagagaaagacuucuucagcgaaauccacaucgaacugggacgcgaaaugaagaacacggcugaggaccgaaaagagaugagcgcaaucauccaggcaaacgaaacaaccaaucuccgaaucaaggcgcugcucaaugaacuccuccaggacaagaaaguugagaacgugcggcccuacagccccucccaacaagaaauacuaaaaauauacgaggacgggguacucuccucagacauugagauaccagacgacauccagaagauauccaaagcagcccaaccaaccaagagcgaacuacagcgcuacaagcuauggcuggaacagaaguacagaucccccuacacgggagcgaugaucccucuuggaaaacuguucacgagcgaguacgaaauagaacacaucauaccacaaucucucuacuucgacgacuccuucuccaacaaggugauaugcgagucagccgucaacaagcuaaaggacucacgacugggcauggaguucaucaaagaaugccacgggauggucguagaaacgggauucggcaaaucagucacagucuucgaggaagagacguauagagauuucgucguucaaaacuacuccaagaaccacagcaagaaaucaaaacugcugcuggaggagauacccgagaaaaugauagaacggcaaaugaacgauaccagauacaucucaaaauucauauccagcguguuaagcaacaucguccgcgaagaaguaaacgacgacggagucaacagcaagaacauagugccagggaacggcaagaucaccacucaacugaagcaagacuggggacuaaacgacaucuggaacgagcucauauugccacgcuucgaacgccugaauguacuaaccgacucaaaacacuucaccgcauggagugaaaaccaucagcgucuccuccccacgguacccaucgggcugucaaagggguucuccaaaaagagaaucgaucaccgccaccacgcgcuagacgcucuagucauugccugugcgagccguaaccacaucaacuuccucaacaacgcgcacgcuauugacaagaagaaaaauucugaagagaaacaaaaauuccggcacgaccuaaaggccauucugugcgacaagaaauacagcgauaaaagugagaaaaacuaccgcuggauauuuaagaaaccaugggacaacuuuaccauagacucaaagaacgcacuagacaaaauaaucgucuccuucaagcaaaaccuuaggaucaucaauaaggcgaccaaccgauacgaaaaaugggucgaccgggacggaaucaaaguaaaagaauggcacaagcaagaagggaucaacugggccacccgcaagccccuacauaaagauacggugagcggaaaaguggaccugaagagaguaaccguccccgaaggcaagauccucacagcgacccggaaaucccuggacaccucguuugaccugaagguaauagaauccauaacagacacugggauacagaaaauucugaaaaacuaccucacaaguaagucgaacaacccagaacuagcauucagcagugaaggcguggaagacaugaacaaaaacauacgcaaguauaacgacggcaaacuccaccagccaauauacaaaguccgcauauucgagcucggcuccaaguucccccucggccaauucggcaacaaaaaguucaaauacguggaaacggcgaaaggcacuaaccucuucuucgccguguacgaggacgagaacaagaaccgcaacuacgagacaauaccacucaacgucguuaucgagcggcagaaacaaggacucagcagcgugccgauaaaaagugaaaaaggccacaagcugcuuuucuaccucucaccaaacgauauagucuacgucccggguucgaacgaagaguucagcaucgaccgccuauaccgguucaccgacuccuccgacaagacagccaacuucauuccucuauccguuuccucccugauuuucucaagcaauaagaacgaacaaaagaaaaucgggaucuccuauccgauccaggacgaguucggccuuggaucaccccaaagcaaaaaccaaaagucaaucgacggaauuaugaucaaggaaaaaugcgucaaagucaacaucgacaggcuggggcgagugucauucuga

SEQ ID NO: 6861 - RNA, 4368 nt, Artificial Sequence
  Cas9 variant
auggcuaaaauccugggccuagaccuaggaaccaacuccaucggcugggcagucguggaagaucaaaacaacaaaaccacacucaucgacaaaggagucagaaucuuuucagaaggggucaagauagaaaaagggaucgagaaauccaaagccgccgagcggaccgacuuccgguccgcccgcaagauaaaguuucgccgcagacuaagaaagcaagaaacccuaaaaguccuaauagaaaauaauaugugcccacucacgauugaggaauggacaaaauggaagaaagacaagaaagaauaccccaaaaauccagacuucauaaacuggcuaaaaacggacgaacucaagaacaucaacccauacuuuuuccgugacaaggccuccaggaccgaacuaccacucaugcaaacaggacgggcccuguaccaccuggcgcaacgaagaggcuuccucuccaaccgauuagaccaaggcucggauggcuucacggagcaaauccgacuggaccuaaucaagaagaucgaaugcgagaccgauaaaaccgaacugcugacgagcguccaaucaaucaucgacacuuacagugaagaagaggacaaggacgcuaagaaacuccugaaaggcgucgaaaaacugugcaaaauaaacaacgagcuaccaaucacagaguucaaggaaaagcugaucaacuaccucaacaaagccgacaaccuaggugcagucaagaaaggcaucgcagacgucaguaagaaaauaaccgaaacaggcugcgagacccucggacaauacuucuacaaacucuaccaaaaccaaaguaaaauccgcaaaguuuauaccgcccgaacagagcacuacuaccacgaauuucucaaaaucugcgagacccaaaacauaugcgaccagcugaagcacaaacucgacaaggccaucuucuaccaacgaccgcucaaaucccagaagggccugaucggcaaaugcgucuuugaaaagaauaagacccggugcgcagucucccaccccgccuaugaggaguaccgcgcccuccaauucaucaacagcaucaaagucucggaaaccaaggacggcaagaaagacuuccucagcuuugacgagcgcaagaaaaucuggcccaaauucauccggaaauccaaaccgaacuucgacuucaaagaaaucgccgaaacacucgacaaaaagggccucagccgcuauuacaacuauacaggccacacaucggucagcggauguccaacaauagcccagcuuacaaacauuuucggugaaaacuggcaagagacacuguucgagaaauacaccaacaagcaaaacaccaagggccugaaaaccaucgacgaggucgugacagacaucuggcauguccucuucaccuucgacaaagacgagaaaaucauagaguucggaaaacagaagcucggacugaacgaggugcuagccaagaaauuuggugccaucaaccuaaagaaggacuacgccucacugucucuaaaggcaaucaauaaaauccucccauaccucagagaaggccugauauauucauacgcagucuuccucgccaacaucgaaaacguuguaggggaagagauuuggaagaacgacgagaacaaaaaccucauaaagaaagaacuccaccuacucauugacaacuucaacgaaauaaaaggacuagaggcgguaguaaacgacuucauugccgacuucaaaaaggaguacaacaaugcacacaaagauuacguucuugacgaacaggacaagaaaauccugcuagagaaaaucgaaucaaacuacggcaaaaacaaauucgagucgcucgaacccgacaagaaaacggaaaucaucaauagcacagagaaaauggucgccgaacaacugcggaagcaacggggagaguucaucaaacccaaacgacuagacgagaaaauaagcgaguucuuaaucaauaacuuuaacgucacgaagaaaagcaucgcccggcuuuaccacccgagcgauguagaaaucuucaaaacggcuagccgcaacagcgaaggacuucuuuuacucggaucccccauugucuccagcaucaaaaacccgauggccaugcgcgcaaugcaccaacuccggaaacucguaaauacauuaaucaaggaaaacauuaucgacgaagagacaaagauuaacauagaacucgcucgcgaacugaacgaugccaacaaacgagcggccauaaagaaauggcaagacgaacgccaaaaagcccgcgaagaauacaagaagucgaucaaagaguuguucaaagcugaauguggcaaagacaucgaacccagcgacucagagauacuaaaauacgaauuaugggaggaacaacagcacaucugcaucuacacaggaaaaacaaucaacauaugcgacuucaucggagccaacccgaacuucgacauugagcacaccaucccgaaaucccuuugcuucgacaacuccaaugaaaaccucacgcucugcgacauucaauacaaucgggacgucaaacggaacaagaucccaaccgaacugucugauuacaacagcaucaaaccccgccucgauaaguggcucguguucaucgacgauuacgaaaaacucuacaacacacgaaagaaagcuaaaggcauagaaacaaaagagcaaaaagacaaacgcaucaaagaaaagcacuacuacaaacuccaucuggacuacuggaaaggcaaauacaaacgcuuuauaauggucgacguucccaguggauucaaaaacucacaaauagucgacaccggcaucauaacaaaguacgcgaucuccuacaugaaaucgauauuccccaaagucuauucagucaagggaaacauugucgccgaguuccgaaaaaucuggggccugcaaaacgauuacgaaaagaaagagcgcgucaaccauguccaccacugcauagaugcaaucacaauagcgugcaugagcaaacagaaauacgauacccucgcaaaaauauaucacgaagacgaagcaggguuccacaaaaucaagaaagaaacgcagcuagucagcaaacccuggacaucauucaccauggacgugcugaacauagaaaaagaaaucuucguaucacaccauacacccgauaacaugaagaagcaauccaagaaagucguucgcgagcguggcaucauagcaccgaaagucaucuacgagacagacgcgaacaacaauacccugagagacaaauacggaaagaaaaucgucaaagaauacauccuauuaaaagacgucaacggcaaccuaaucccaauaaaaggaaaacgccuuacgccgagugacauaauaaauaaaguggacgggaucgauuacuucucccugaucauaaacgacaagauccaguacuacgaguucgccaaaucgaaaaagaccggaaaaauuauauacaagaaagaaccaaucuaccuacagggcgauaccguaagaggcucacuucaucucgacacauucuacggggcaauagcgaaagauauaaacgguaacauaauaacaaauacaaacgggaaaauugcgcccaacuacguaauacggaaagaacucucgaaacugaaagaaaccgacaucgaaaauaucgucgacccggucguaagaggaaaaaucaucgaagcuaaaaagaacaagcucaucacuuucaacaaauccggcgcagucauaaagaccaccaucuggaugaaggaaaaccaaauacccaucaacaagguacgcguuuauagcagucucaagaacccccucccagacuucaagaaacacagagaccugucccaccucacauacaaacaacaguacaaugucuccaacgaagaaaacuacugucucgcaauuuacgagggcaaaaacaagaaaggcaacguaugccggaccugcgaguuaguaaauaugauagacgcaggcaacuacuacaggcucuccaacaagaacuggaaacaacaauaccccauugucccagaaaaagacagcgucaccaacuacagcuugaaaacuauaaucaccaagggacucaugguguuacuauacgaaaagagucccgaagaaaucugggaacucacguacaaccaacaaauggaacgacucuacgaaaucacgcaacuggacacugagaaaagcgcggaaauaaaacuacuauuccaccaggaagccagggaaaagaaaguuaucaccgaauacaugggacucaagacagggaugaaagggggaaagaauaucggaaaacacaaagaguuccccuggaucaaaguagggccaaacaguuucgacgcccucaucgaaggcauagauuucaagcuaacgcccaccggcaaaaucauaaagcuguga

SEQ ID NO: 6862 - RNA, 4374 nt, Artificial Sequence
  Cas9 variant
augaaaaccauccugggacucgacuuggguacaaauagcauaggcugggcaaagguaucugucgacgacuacggcaauuaccugcacgacaucaagcuagggucgcgcaucauaccaaugagucaggauguacucggaaacuucgacucaggaguaacggucagccagacagcacaacgaaccgaguucagaagcaagaggcgacugguccagaggaaccuccagcggagggagcgauugcacaggguuuuacacguacucgauuuucuccccgcccacuacgacgcggccaucgggugggaucggaccgaagccgucacguacggaaaguuccugaaucacgcagagccgaagcuggcaugggaggagcucggcaacgggaaacgacgauuucuauucauggacagcuuccacgaaauggucgcagacuucgcacgaugccaacccgcccuggucgcagacggcaagaaaauaccgcuagacuggaccauauacuaccuaagaaagaaagcacucacacaagccauaacuaaagaggagcuagccuggaucuuacucaacuucaaccagaaacgcggguacuaccaacucaggggagaagaagaggaagaaaaucccaccaaacaagaagaguacuacgagcucaaagucguguccguagaagccacggauagcagaaaaggcaaugacaccugguacaauguucaucucgaaaauggguggaucuaccggcgauccagcaagaucagccuagacgacugggucgggaaagugaaacaguucauagucaccacagaguacgaaaaagacggggcuacccucaagaccgauaaagaaggcuacguaaagcgcucguucagagcaccaaacgaaaaugacugggggcugcgaaagaaacgaacugaaacccuccucgagaugagcggaaaaaccguaggagccuucauuuacgaccaucugcuccaagaaccggcagacaaaauccggggcaauuucauccggacaaucgagcggcacuacuacaaagccgaacucgaagccauccucgccgaacaaugcaaauaccacaucgaacugcgggacaaagaaaugcuagaggcgugcgcgcgagaacuguaccuuaauaaucuaccacaccaaagaucacugaugaagaaagacaugacauaccugcuccucuacgaccugaucuuuuaccagagaccguuaaaauccaagaaagcgcucaucgcuaacugcccguacgaauauuacgaauacguagacaaagaaacaggagagauaaaaagacagaacaucaaaugcauagccaaauccaacccauacuuccaggaguucaggcuauggcaguucguccugaaccuacgacuuuucgaucgugucgaagacaaggaagucacggcaaacuaucuaccgaccgccgacgaccacgcacgccuguucacguaccuaaacgaccggaaagagauaaaccaggaaacgcuacugaaagauuauuucaaacucaagaaaguaaaaaucggcaaugagaaggaguauccgauacgauggaacuauauugaagacaaggaaaagaaauacccauguaacgaaacccgguaugagcuccucauggcacucgaccgagccgggauagaacacaaauggcucgacgacaacaaccucgaguaucgacuguggcaucugcucuacagcguugaaguaaagagcgaaagcgaaaccgcauugcgcaaacucaaaaacgacgacgccuucgugaacagcuucuuaaaagugaaaccuuucaagaaagaauacggcgcguauagugaaaaagccauaaaacgucuacuggcugucaugcgcaagggauuccuguggaacgaacaggacauuugcgacgaaacgcggaagagaauagaaauaauuaucaaaggagacguagaugaaaaaguaaaagagcgaaugggacacgccgccuacagcuucgaccgcguauccgacuuccagggauuacccgaauggcucgccugcuaugucguauacggacgccacuccgaggcaauggacauacagcacugggacucaccagaaagacuuauggccuacaucaacaacuucaagcaauacagcuugcggaaccccaucguugaacaaugcauccucgagaccuugagaacgguccacgacaucuggaaggaaaccgggcagaucgaugaaauccacgucgaacugggucgggaaaugaaaucgaccagcgaagagagagcaagacgaacccaaaacguccuacgcaacgagaacaccaaccugcgcauaaaaagccuccuaaucgaacucaaaaacgacaccgacaucugcaaugugcacccauacucaccgaugcaacaggaaauccuccgaauauacgaagaaggcgccuuacaagagcuaaacagagaagacgaggacuucgaagaaaucagcaaaauaucacaaaugucacaacccucagggaaagagcugaaccgauacaagcuauggcuagaacagaaauaccggagcccauacaccggaaaagccaucagucuggccaaacuauuuacaccagcguaccaaaucgaacacguuaucccacaaucgagguacuucgacgacaguuucaccaacaagguaauaugcgaagcggaagucaacacguuaaagucuaaccuacucggguacgaguucauuaagaaacacggaggggaaaucauacacugcacaacccuuggagacguacggaucuucuccgaauccgaauacaaagccuucgucauggaccacuaugccaacaacaaauccaaaaaggacaaauugcucauggaggacaucccacaagaguuucuaucacgacaaaugaacgacuccagguacaucagcaaaguugucaagacccuccuuucgaacauaguaagaauggcggacgaauccgaagccacaucuaaaagcgugaucguauguaccggaggcgugacggaccgacuuaagaaagacuggggacugaacgacguauggaacagcaucgucuacucccgcuucgagcgacucaaccggcuaaccggaacagaggccuucgggcacugggaaaauaaagacggcaaacgcguuuuccaaaccuccaugccacuagaacuccaacgcggauuucgaaagaaaagaauagaccaccggcaccacgccauggacgcgcuagucauagcaugcgccucgcgaaacaucguaaacuaccucaacaacgaaucggcaaauaaccccaagaaaagagaagaccugcgcaggcaacucugcgacaaaaaucgagucauccgcaaaccgugggaaacguucacucaggacgcguacaacgcgcuggaaaacguaguaguuagcuucaaaaacuacgugcgcguaauaaacaaagcaacgaaccgcuacgaacacuacgacgaaaacggaaagaaacgguucguacaacaaaagggcuccgaauuaugggcgauacggaaaccaaugcacaaagaaaccuacuacggccacgucaaccuacgacgaaaagagcucgucacccuccaaaaggcccucgacgacauaccgucaauaugcgauaagaagcuacgggauuacaucagcgcacucguagaaaaacacuucaauaagcgacagcuacuagcccauuucaaauccacagauuacuacuggcaaaagcaauacguaaacaaggucuacgucuggaccuucuccgacgacauaaagccccuaguagcaacgcgcaagcugcucgacaccucauucgaugcgaaaaggauaggaacgauuacggacacuggcauucagaaaauacuccgcaacuaucucgaggccaaaggcggaaacgcuacccuggcguucacaccagaaggaaucgccgagaugaaccaaaacauauccaaauacaaugacggcaaaccacaccaacccauacucaagguccgcauaacggagcccaugggcgcuaaauaccgagucggacaaacaggaaacaagauggccaaguacguugaagcccaguccggcaccaaccuuuacuucgccauuuacgaagacuccgaagggaaaaggagcuacaccacugucccccuagacgaaguggccgagagacuaaaacaacgacuaucaccaguacccgagaaagacgaaaacgacgucccccucaaauucuaccuaagcccaaacgaccucgucuacguccccacugaggaagaacugcaacuucgagaaugcaaacuaaacaaagaccgaauauacaagauggucucaagcaccggcaaugaaugccacuuuauacccuacuacguagcgaacguaaucuacaacaagggcggguucaauaugcagaugcaccgcccccaguccuga

SEQ ID NO: 6863 - RNA, 4374 nt, Artificial Sequence
  Cas9 variant
auggccaaaauccucgggcuggaccucgguacaaacagcauuggcugggcaauagucgagaagaacaauucagacuucacacuuaucgacaaaggaguccgcaucuucuccgagggagucaaaacagagaaaggcaucgaacgguccagagcagcagaacgaacaggguaccgcucagcaagaaagaucaaauaccgccggaaacuccgaaaauacgagacgcugaaaguccucuccaagaaccggauguguccgcuacaaaucgaggacgucgaggcuuggaagaagucgggguucaaagauuauccacucauccccgaguuccuccaaugguuacgcaccaacgaccacgaaaacguaaaucccuacuucuuucgcgauaaagcaucaagagccaagguguccuuaugggaacuggggcgggcguucuaccacaucgcacaaagacggggcuuccuguccaaccgcuuagaucagucaagcgaaggcguucuagaagaacacaacccccaaauacaaucccugaucgaagaccuagaagaaacaagcacaauccucaacgaagugagagacuacuacaucaaucucggccugcucgacggcgugaaaggggacuucaagaaagaacucgacgagggcgagaagaaacugaaaagccucuacaacacacuaaucgcgaucaucaagaaaaacgagaacgacguccagaaauguaaagacgaaauuauaaaaagacucaacaaaaaggaggaccuagggaagguuaaagggaagaucaaagacaucagccaggcaaugcuagacggaaacuucaagacgcuggggcaauacuucuacucccuuuacaacaagggcaagaucagaaaccaguacaccagccgcgaggagcacuaccuccaggaguucauaaccauaugcaaggugcaaggcauaaacgggauaaacgacgaagaaaucuugccggaaaagaaauucaccggccuggccaaagaccuguacaaagcgaucuucuuucagcgaccccucaaaagccaaaagggccugaucggaaaguguagcuucgaaaagaacaaaucaaggugugccaucucacaccccgacuucgaagaauacaggauguggaacuaccuuaacaccauaaaauucggcacgcaaagcgauaagaagcucagauuuuugacccaagaagaaaaacucaagcuaaucccaaaauucuaccgcaagaacgacuucaacuucgaagugcucgccaaagaacucauagacaaaggagcgaccuuuggcuuuuauaaaagcagccggaaaaacgaguuccuauauugguucaacuacaaacccacggacaccgucucagcaugccaauucagcgcgucccuaaagaacgcaaucggagaggauuggcagacgaaaguauucaccuacaagacacugaacucggaaaagaaggaaguaauaagaacagucgacuaccgagauuuguggcaccuacucucagccucgacuuccgacauuuaccucuacgaauacgcgaaagagaaacugggacucgaggacaaaucugcaaaaaccuucucaaaaaucaagcucaagaaagacuuugccucgcucagucucagcgcgaucaauaagauacugccauacaucaaagaaggacugcuguacagucacgcgguuuucauggcgaacauagaaaagguaguggacgaacacauuuggaaggacguaaaagaacgaacgauaauacaaaacgaaaucucaaaaaucauaaaaucggacguguucgaacgcgagguaaucaacaucauaaacggccuaaucaagaacagcaaaacggagggggaaaacuacgcggaggaaaguaaaaacauuuucaagacggaguucgacaaugccaucgccaagaucuucgaaaagaacaaugauaucgaauuuaaccaacccuuccuggacgacaccuaccucaaauacgucgaggaacucaagaaauucgauaaagcgcguagcuuccuccccgucccgcgacuugacgaaaaaguaauacaauuccuacugggaaacaacaaggacggaaugguauauugcagugacaaaaacaagaccaagaaacuguaccaccccucagacauagaaauauucaagaagaaaaucaucaaagacgaguucgguaaugagaaaaugguccuggggaguccccucacaaccagcauuaagaacccaauggcgaugcgcgcccuccaccagcuccgaaaaguacucaacacucugauccucgaggaacaaauagacgaaaacacacgcauccacauagaaauggcccgcgaauuaaacgaugccaacaagagaaaaggcauucaggauuaccaaaaugaaaacaagaaauuccgggaagacgcaaucaaggaaaucaagaaacuauacuucgaagagugcaagaaggaagucgaacccacagaagaagacguccugagguaccaacuauggaucgagcaggacaagaaagagauauaugagcaaggaaaaucaauccgaauaucggacauaauagguucgaacccggcauacgacauagagcacacggucccgcgcagcauaucccaaaacaacucccuuaugaacaagacccucugcaccccgcgcuucaauagagagaucaagaaacagaaaaugccgauagaacuaagcaacuacgaagaaauccucccacgcauagaacacuggaagaaagaagccgaagaccucacgaggcagaucgagucaaucagcaaaucaaucaaaucagccucaacuaaagaagcaaaggauaaaaacauccgucgccgacacuaccuaacccucaagcgcgacuaccuaaaggggaaguacgaccgauucauaugggaagaaccuaagguggguuucaaaaacucccagauaccggacacuggaaucauaacaaaguacgcccaagcguaccuaaaauccuacuucaaacgggucgagagcgucaaaggcgguaugguagccgaguucagaaaacaguggggaauccaggaaagcuacauagacgaaaacggauuuaaacacuacaaggagaaagaccggagcaagcacacgcaccacacaaucgacgcgauuacgaucgcaugcaugacaaaggacaaguacgacguacuagcucaggcuuggaccagugaagaugaacaggacaaacaaaaagcgaaaacucugaugagcgaggcuaaaccauggaagaccuucaaggaagauauagagaaaauagaggaagagauacucgugagccacuucacacucgauaacgucaagaaacaauccaagaaaauaguccgaguacguggcaaaaagcaguacguggccgagaucgaacgagacgucaauggcaaagccauggcaaagaaggaugcgaacgggaaaaucaucuacaaacuaaacgaaaagggcgagaaaaucccgagacuccaacagggagacacaauccgaggcagcuuacaccaggacuccaucuacggagccaucaagaacccccuuaaccaggaagagaucaaauacgucaucagaaaagaccucgagagccugaaggcuaaugacguggauaacaucguagacgaaaccguaaaacaaaagguuaaagaagcaauagaaaauaagauccuacuucuauccucuaacgcccagcaaaagaacaagcucguggacgacgucuggcuuaacaaagaaaaacaaguaccaaucaagaaagugcguauauacgcgaacuccguaaagaacccgcuggaaaucaaagagcagucccuccucagcaaaagccgcaaagagcacaaacaaaagguuuacgggcaaaacgacgagaacuacgcuauggccaucuacgaauuagacggcaagcgagaguuugagcuaauuaacaacuucaaccuagccaaauugauaaagcagaaagaaggcuucuacccccugaacaaggaaaaagaaguaaagggcaaaaagguucucuaucccaucgcaaagucgaacuaccgcgacguaguccugaaacgcggacaacaggugguauucuacgacaaagagguagaaaaccccaaagacaucucagaggucauagacuucaagggacgaauauauaucaucgaagggcucagcauucagcgaauaguacgcccguccggaaagauagaugaauacggugugauuaugcucaaguacuucaaggaggcccgaaaagcagaugagaucaaaaaggacaacuacaagccagacggcguguucaagcucggcgaaaacagaccaacccguaaaaugaaucacagccaauuuaccgccuucgucgaggggaucgacuucaaagugcuaccgacgggaaaguucgacaagaucuga

SEQ ID NO: 6864 - RNA, 4377 nt, Artificial Sequence
  Cas9 variant
augacaaagacaauacuaggccuggaccucggaaccaacucaauagggugggcacuaaucaaccaagacuucgacaacaaaaagggugaaauacucggaaugggcucucgcaucauccccaugacgcaggacaucaaagaugaauuuggcaagggaaacuccaucucccagacagccgaacgaacacgccuucgcggcgucaggcgccuaauccaucgaacccuccugcgccgggaacgacuccacagagugcucaauaucauuggcuuccuccccgaacacuacgcaaaccaaaucgacuucgagaaacgguucggaaaauucaaaccggaaagcgaaccaaaaaucagcuucgacggaaacgacguguuccuauuugaaaagagcuaccaagagaugcugguagacuuuaagauacaccaaccccaauuagucucgaacggcaaaaagauaccccacgacuggaccauauacuaccuacgcaagaaagcccucagcaagaaaauagaaaaagaggaacucgcguggauccugcuaaacuucaaucagaaaagagguuacuaccagcuacggggagaggaagaagaagagacgccuaacaaacucguggaguuccacucauugaaaauuguagaaguaaaugccgaugaaccacaaaaaggaaagccugaaaucugguacagccucguacuugagaacggauggguuuacagacgagccucaaagacgccacuguucgacuggaaagacaagaucagagaguuuaucguaaccaccgagaucaacaacgacggaaccguaaaaacagacaaagaaggcacagagaagagauccuuccgggcgccaaaacccgaagacuggacacuccaaaagaagaaaacagaguucgagcucagcaaauccgggaacgaagucggcgcuuucauauacgagagcauccuucaaaaaccuaaccagaaaauaagaggaaaacucaucuccacgauagaacgaaaauuuuauaaagaagaacucaagacgauccuaaagacccaacuuuucuuccauaaggaacucaaggacgaaaagcucuacaacgcaugcaucgaagaacuguacaaaaacaacgaagcccaccggucccuguuaaguaacaaaggguucgagcaccuauucauaaacgauauacuauucuaccaacgcccccuccggagcaagaaaucccagauaucgaacugcccccucgagaaaagaacauacaagaaagaaggaauugaaaucacggaaggcauaaaggucaucuccaaaucaaacccgauauaccaagaauuuaggcuuuggcaguggaucucgaaucugagcuuguacugcaucgagccgacagagaccaacguuaccucaacauuccucaacuccaucgaggacuacgagaaccuauucgaguuccucaauaaccgaaaagaaauagaacaaaagcaccuacuaaaguaucuacucgaaaaccagggguucaaaggaaagcugcucaccaacgaacucgaaaaauuccgauggaacuucguagcugacaagaaauacccauguaaugagacaggcucccuacuacacaccagacucuccaaaguuaaaaacauaagccccgauuuccucaccaaagagaucgaacaccagcuauggcacauuaucuacuccguaacugauaaaaucgaauacgaacaagcccuaaagaccuucgcccgcaaaaacaaccuggacguagacucguucuucgagcacuucaagaaaaucccgcccuucgaguccacauacggagcauacucagagaaggcgaucaaaaagcuccuaccacuaaucagacucggcaaguacuggaauugggaggcuauugacuccaucuccaaagacagaaucucgaaaauccucaguggcgaauacgaugaaaacaucaaaaaucgugugcgggagaaagccguccaucucacuagcgagaacaacuuccaaggucuccaggaauggcuagccaaguacaucgucuacgacagacauagcgaaggcaacgaucucggaaaauggaccagugugucagaccuagaaacauaccugaaagaguucaaacagcacucccugagaaacccaaucguagaacaaguaauaacagaaacccuccguguugucaaggacaucuggaucaagcaugggaaggggacagaaaacuucuucgacgagauccauguagagcucggccgagaaaugaaaaacaacagcgaggaccgaaaacgccucaccaacaccaucaccgaaaacgagaacacuaaccuacgcaucaaggcacugcuuauggaaaugaugaacgauaaugacguugagaacguucgacccuacucacccucgcagcaggaaauacuuaaaaucuaugaagacggagcccucaacuccaauaucgaacuagacgacgaaaucgucaaaaucuccaagaaagcagagccaacuaaaucagagcugcagcgauacaaacuaugguuagagcaaaaauaucguucccccuacacaggacaagucaucccccucaacaaacuguucacaucagaguaugaaauagagcacgucguuccacaaucaagauucuucgacgacuccuucagcaacaaaguuauaugcgaaucagcaguaaauaagcgcaaagacaaccagcuaggccuucaauucauuaaaaaccacuccggcgaaaaaguugaacuuggcuucggaaaaguaguccaaguauucacagaggagcaauaccuggacuuugucaaagaacacuacuccaagaaccggagcaagcacaacaaacuacuucuggaggaaauccccgaaaagaugaucgagcgacaacucaacgacacgcgguacauauccaaguucguaagcuccauucucagcaacauaguacgcagcgagaaagacgacgacggacuaaacuccaaaaauauucucccagggaacgggaaaaucaccacggaacucaaacgcgacuggggccuuaaugacgucuggaacgaccuaauccucccccgauucgaacggaugaauaccauaaccaauucggaucucuucacaaccuacaacgacaaauaccaaaaacaccuacccacggucccauucgaguacuccaagggcuuccaaaagaaacgaauagaucaccgucaccacgcgauggacgcacuugucauagccugcgccacccgugaccaccuaaaccuaaugaacaaccaguccgcuaaauccgagcucaaacgauacgaccuucaaaacaagcuacgcaagaaagagccguacuucaaucaaaaagagaauaaacagaaagaggccuucaaggacuucauuaagccguggggcacuuucacugaggauuccaaaaacgcguuagagaagauuaucaucagcuucaaacagaaccuccgcgugauaaacaaagccacuaacucuuacgaauccuacaaagacgaagacggcaaccugcguauaggaaaagacggaaaaccagagaaaggacucaucaagcaaaagggacucaacugggccauucgcaagcccuuacauaaggacaccguaagcggacaaaucaaccuaagucgaaucaaauuaccgaauggcaagauccuaacagcgacacguaaaaaccucgacaccagcuucgacuuaaaaacaauugagaacuccaucaccgacacuggcauacagaaaauacugaaaaacuaccuacuaucgaaagaaagccccgagcuagcauucagcccugaaggccucgaggaaaugaacaacgagauagagaaauacaacaacggcaaauuccaucacccaauaaacaaagcacgaaucuacgagcucggcuccaaauucaaugucgggcaaacgggcaauagacgugauaaauucgucgaagcugccaagggcacgaaccucuucuuugcaaucuaucaagacgagaacaagaaccguucguacgaaacaaucccacuuaaugaggucauagagcaccaaaaauggagggccucgcuaccaaaagaggaacaagagaagauuccacuuguaccggugaacaagcucaaagggacguucauauucuccuuauccccgaacgaccugguuuacguaccaagcaacgacgaauuagaaagauccgccagcaucgacuucagcaaacucaaaaaggaacagauaaacagacucuacaaaauggucucaagcuccggcucucaaugcuucuucgugaaauccgagguagccacuucggucgucaauaaaauggaguacucgagucuaaacaaaauggagaaauccaucgacaaccucaugguuaaagaaaucugcauuaaacuaaaaaucgaucggcucggaaacaucuccaaagcguga

SEQ ID NO: 6865 - RNA, 4377 nt, Artificial Sequence
  Cas9 variant
augaagaaaauccucggguuggacuuaggcaccaacagcauagguugggcccuaaucgaacaagacuucgaaaguaaagcaggcaaaauuucaggcgccggaucgcgaauaaucccgaugagucaggacauccucggcacauuugaaaccggccagagcuacucucagacagcagaccgcacccacuaccgcuccauacgccgccuuuaccagcgcaccaaacuccggagggaacgacuccaccgaucacuaaaugugcucggcuuccuccccgaacacuacaaaaacgaaaucgauuucgagcaaaggaaaggacaauucuaccccaacaaagaaccuaaaauagccuacuauccggaacaggucgcguccaaaguaaaguaccaauuucuguuuaagagcucauuccuggaaaugguagaagacuucaagcggcgcggcuacaacggcgcaauuccguacgacuggacgauauauuaccuacggaaaaaggcccucgaaaagaaaauugagaaagaggaacuggccuggcuucugcugaacuucaaccaaaaacgaggauacuaccaacuccggggcgaggaagaagauacaaauagcaacaagaaagaggaguucuacgaacucaaagucagcucggucgagcaaacacacgauaccuccccgagcggaacaugguacaacguccaccuccaaaacggcuggguuuaucgccgaaaaagcaaagacucccuaaaagacugggaggggcuaaacaaaaaguucauugucacuacgcaccucaacgcggacggauccgaaaaacuggauaaagacggcaacguaucccgcucuuucagagcccccaaagaggacgacugggggcugguuaaaaagcguacagaaagcguacucgaaaagagcgggcuacacguuggagaguucauauacgaaucccuccucgaaaaucccgagcagaagauacgcggguccuugaucaaaacgaucgaacgcaaauacuacaaaaaggaacuagaagcgauccuagacaaacaaacgucuuuccaccgcgagcuuaggaacgacgcccucuacaaggaggcuacauuagagcuuuacccgaaaaacuccgcacaccgcagcaacaucaaacagcgcggguucaaauaccuuuucauagaagacauaaucuuuuaccaacgcccgcucaaaucccaaaaacaccucaucgcacacugucaguacgaaaaacgcacauacaaaaacaacggaggcgaaacgaucgaggugagccuccagggggcccccaagagucacccgagcuuccaagaauuuagaaucuggcaauucaucucaaaucuaagauucuacgacaaggaagaaaucguggagggacaggagguaagcauaacggaaaaacuccucaagagcgacuccgacuucgccgaacucuaccacuggcuaucccaccagcgagaaguggaccagaacaaaacacucaaauauuucacacaaaagaaacuuauucccaaacagaagaaagacaaccccaccaucagauggaacuuuccagaagacaagaaauaugaaaugggcgaguucaaagcacaacuccucagccgacuagaaaaaguccgaaacugccagcccgacaaauuccucacccagaaaaacgaacuagaccuguggcauauaaucuauucagugacagacaaaaccgaguucgaaaaagcccucgucacuuuugccgaaaagcgagaacuggacuccgaaucguucgucgaaaacuucaagaaguucccgccauucaagaacgauuaugcgagcuauucccuaaaagcaauaaagaagauccucccccuaaugaggaggggcaaauacuggaaagcagaaaaucucgguccccaaacauuacaacguaucgagaagaucgucaacggcgaagccgacgacaaaauaagcauacgcgcccgcaaacucgcacugcaccuaaacgacaccaagagcuuucaagggcuuccaacuucccucgcaugcuaugucgccuacaaccgacacagcgagaacgaagaaaaucaaaaguggcagacgcccagcgauaucgacaaauaccugaaagacuucaaacagcacucccuccggaaccccaucguggaacaacucauaaccgaagcacuacgugugguucgagacauauggaagcacuacggacaaggucagaaggacuucuuugacgaaauucauguagaacuaggacgggaaaugaagaaucccgcaauaaaacgcaagaaacuaagccagaaaauacaagaaaaugagaacacgaacuaccgcauaaaagaaguacucagaaaucuaaaagagaacaacaucgacgccaaacccuacagcccgucacaccaagaaauacucaaaaucuaugaggaagggguauaucaaucaaucgaaaacgucgaagacgaaauagagaagauccgcaagaauaacacuccgagcuccaaagacauaaaccgauaccgccuauggcuagaacaaggauacaucucccccuacaccggagaaguaauaccccucagccaacuauuuagcaaucaauacgaaauugaacacaucaucccccgcucccgguuuuucgacgauuccuuggcaaacaaagucauuugcgaauccagcgucaacgcucuuaaggacaacaaaacagcccucgaguuuaucaccaaccauggcaacgagaaagucgaguucgccggaaaaacaguagaaaucuuaucauccgacaaguacacagaacacugcaagcgguacuucaaaaggaaccguaccaaacugaaaaaucugcugucuuaugacgucccagagggguucauaaaccggcaacuuaaugacucgcgcuucauuuccaaguauguccgaaaccuccucagcaacauaguccgugaagaagaggaacgcgaagcaauaucaaagcacauccugacgaucccagguucgauaaccagccagcugaaacaagacuggggacuuaacgaaaaguggaacgaagucgucacccaccgcuucgagcgucuaaacaaccuaacuggaaccacggacuucggguucugggacaacaaaauaaacgcauuccgaauaacagugcccaaggaacuaagcaaaggauucaacaagaaaaggaucgaccacaggcaucacacacuugacgcacuuguaauagccgccuguacaaaagaccacgucaauuacaucaccucccuuaacaccgagcgaaacaaucacucccucguaucaaaacuaagaaauacaaagaaaguccucaucaacggcaaagagagacgaauagcaaaggcuuacaaacuccccugguccagcuucccgcuugaugcaaaacaccaacucgaaaccacaguuauauccuucaaacaaaaucuucgcgucauaaacaaaucuucgaacaaaaccuggcaauggagaaacgucaacggagaacagaaaaagaaacuaauaccacaaacaaaaggcgauucaugggccauacgcaaaagcaugcacaaagcaacaguaagcgccaaaguagaaagcguaggcaagggcaaaauaaagacgacaaaccgaacgccccucggagagaucaaaggagaaaaacacgucgagaaaaucuacgacgcacgcauucgagaagucaucaucccgaaccaccuaaacaaguaccucgacgagaagggaaaacccaauuacgaggcagcauucucccaauccggcaucaaacagcuaaacgaaaacaucgaaguccugaacgaaggaaaaccacaugccccaaucuauaaggucccacucuucgaaguaggaagcaaauuuccuguuucagaagacgcaaagagccccaagaaccagaaauaugucgaggcagacaaaggcaccaaccuuuucuucgcaguauacuggaacgaagagaaacaaaagcggaacuuugaaaccguaccacuccaccaggucaucguccaccaaaaacaaguagccucacuacccacggaacaacggaccuccgugccgaucaaacccgaacuaggccucuuucuguuuucccuaagccccaacgaccucguauacguaccaacagaagaggaaaucgagaacccacaccuggucgaccucaaaaaucuaagcaaggaccaaaccaaccgcauauacaagauggugucaagcaccggcaacgaaugccauuuuaucccccaccacauaucccgacuaaucaugaaguacaacgccaaacagaaagucggggaauuuggaucccucaacaaggccgagaaggccaucaccggcgagaccaucaaagaaaaaugccucaaaauccaaauaaacagccugggaaaacucaagaccgagagaauagcauga

SEQ ID NO: 6866 - RNA, 4380 nt, Artificial Sequence
  Cas9 variant
augaaauuuaaucuaggccucgacaucggcacaaacucgauaggaugggcccucguuaacgaagacuacgagaacaagaagggcaaaaucaucgcggccggcagcagaaucauccccaugacacaagacauccucgacaaguuuggcaguggcgccaucacggagacccaaacagcacucagaaccgauuaccgcagcaaacggaagcuaauacagcgcuuccugcuccgccgcgagcgccuacacagaguccuuaacguacuggacuuuuuaccaaaacacuacgcggagucgaucgacuucgagaaauacuucggcaaguuucuacccaacacagagcccaaauuagcauacaaccaaaaccaauucaucuuccaaaacagcuuccuggaaaugcucaaagaauuucaagaaaaacacccagaacugcucacgaacaauaagaaaauccccuaugacuggacaauauacuaccugcguaagaaagcccucaaucaacggaucgaaaaagaggagcuagcauggcugcuccuacaauucaaccagaagcgcggauacaaccaacuacgggacgaagaagaagagagcgucccgaacaaacaggucgaguucuacuccuuaaaaaucaucgacgugguugcggaccaacccaaagagggacgugacaagcgcugguacaguaucaaccuagaaaacggguggacguaccgaagagaauccaagacgccccuauucaauugggagggcaaaaccaaggacuucaucgugaccacggaccucaaccaggacggauccauaaagaaggauaaagaggguaaagaaaagcgcucauuccgugcucccuccgagggcgacuggacucugcucaagaagaaaaccgagaaagagauauacgaaucaggcaaaacgcucgguaccuacauauacgaugcccuucucaacacccccgaccucaaaaucaaaggggacuucauuagaacaauagaccgcucuauuuacaaggaggaacuccaacaaaucauaaacaaacaaaaagaauaccaccucgaauuaaacuccucaaaacuauacaaagcgugccuagaggagcuguaccccaagaacgagaucuacaagucggcacuuaaaaauaaagacauagcauaccuuuucauaaaugacaucuuauacuaccaacgcccacuaaaggcccccaaguacaacauaggaaaaugcacauacgaaucgcggaccuuuaagaaagaagacaagaaaauccgcgaauacauucccgcaguugcaaaaucccacccacucuuucaagaguuccgucucuggcaguggaucaaaaaucuaaaaauauacgaaaaacuuucaagcgauaacugcaccgauuucuuucugacgaaugaacaggacuucgaaaaucuauucgaguuccuauggaacaagaaagaaaucgaccacaaaggaauccucgaauaccuugucaaaaccaaguucccugaccucaaaccaaaacagguaaaaaccaaaguaaaagaauaccguuggaacuacguauacgaccacgagaaagacgaaagcaaaaccuaccccugcggugaaaccuacuuccuacucaaaaacaaacucgauaagaucuacaaugcccaggacgacuuccuggacaaggaaaggcucuacaaccucuggcacaucauauacuccgugacagacaagaaacaguacgagaaagcacuagcgaaauuugcccucaaaaaccaccuagacacaaagagcuucguuaacacauucaagcgaauaccaccauuuaaaaaugacuacgccaucuacagccucaaggcgauuaagaaacuccuuccgcucaugcgcguaggcaaauacuggaacuacgacgacaucgaccccaucaccaaacagaaaauacaaugcaucaucaccggugaggagaacgacaccaucagcacccucgugcgugagaaaacuaaccacuucagcaaugaaaacgacuucaaaaaccucccccuguggcucgcaggcuacauugucuacaacucgcacaacgaguccucggagauagagaaguggaaaucaccccaggacaucgacaccuuccucaagaaauuuaaacaacacgcgcucagaaaucccaucguggaacaaguggugacagagacucuacgagucgugcgcgacaucugguccaagaaaggacaaggcaaaaaggacuucuucaacgaaauccacauagaacucggcaaagaccugaagaaccccguagauaaacgccgaaaacuguccucgacaaacacgaagaacgaguccacaaacacccgcaucaaagcccuccucauugaacuuuucacacaaggagucgagaacguaaaaccaaacuccccgaaacaccaggagauccuaaaaauauucgaagaaggggcccuaaacagcgguauagaaaucgaagaggacauaauaaaaauaagcaacaccgaccaaccaaccaagaaacaacucgagcuauauauacucuggcucgaacacaaauacaaaucucccuacaccgggcaaucaaucccccucucaaagcuauucacccccaacuacgagauagagcacaucaucccuagauccaaauacuaugacgacaauuuguccaacaaggucaucugcgagacugagauaaacagauuaaagaacaaccagcucgguuaugaguucaucaacaaccacgaaauccgcgaaguaacccuagaggagggcaaaaccauccgucuccuaucacccgaacaguacuggaacuucgucacgaccuacuacgcaaagaauaaagcaaaacgggaaaaccuucuccugaaggagcuccccguccagaugguugaaaagcaacuaaacgacacccgcuacgucuccaaauauguuaugcagcugcucagcaaaauuguccgcaaagaagacggcacggacaauggcaucaacagcaccaacauauuguccaucucaggcaaaaugacacgggcccucaagaacgacugggaccucaacgacgucuggaaugacuuacugcucuaccguuuugagcgcuugaacacgauaacaaagaccaaccucuucaccaccuacagcgaacaaaagcagaagcggaugccgaucgucccggaccaguacgccaaaggauuccacaagaaacgccuagaccaucgccaccacgcccuagacgccauaguuaucgcgugcauaaccagaaaccacaucaacuacaugaacaaccaaaacauccaaggcgaaaaacucaagaaaaacgcaaucgaaaaagaaaacuaccgagagauccugcaaaaauccaggcuugacaucagagcacagcucugcgaaaagaaauacaacgacaacgauccgaccaaauacaacuggguauucauaaagccuugggcggacuuuacagagaacacaaaggacauacucgaguccauaauccccagcuuuaagcaaaaccuacgcauaaucaacaaaacagucaacuacuacgagaaauacaaugagaacgggaagaaagucaaaguccgccaaauaaaaggagacaacugggcuauccgaaaaccacuccacaaagaaaccauaucuggcaagguccaccucagcuacaaaaccccagcaaaggguaaaauacugaccgccaccagaaaggugcucgacucaucaauggauuuuaagagcaucgagaaaaucaccgacacaggaauccagaaaauccucaaaaacuaccucgaauauaaaaagagccccgaacucgccuucucaccagaaggaaucgaagaacuaaacgcgaccaucaccaaauacaacaauggauuccaccacaaacccaucuauaaggugcgaauauacgaggaaggaguuaaauuucccuuaggcaacaaaggaaacaagaaaucaaaauauguagaagcugagaaaggcacgaaccucuuuuucgccauauauaaagaccaagaaaacaaccgcuauuucgagacaauucccuucaacgacgugcuggaaacacugaagaaggggauguccgcaguaccagagaaaaaucaagaagaaaacacccuaguguuugcccucucgccacaggaccuagucuucgugccgacacuagacgaaauagaaaacccagacaucgucgauuucaagaaucuaacaaaagaccaaacgaaccggauauacaaaauggucuccuccuccggaaagcaaugcuuuuucaucaaagccgaaguggcaacgucuauagugaacaaaauggaguucagcaccucgaacaaaauggaaaacucaaucgagggcauccaaauaaaaucuaacuguuggaaacuuaaacucgaccgccugggcaccaucacccgagucaucaaguga

SEQ ID NO: 6867 - RNA, 4383 nt, Artificial Sequence
  Cas9 variant
augaccaaguucaaccuaggccucgacauagguaccaacaguauaggaugggcccuggucaaugaggauugcgaaaacaagaaagguaaaauucuagcagccggcuccaggauaauuccaaugacgcaggacauccuggauaaauucggaagcggugcagccaccgagacccagaccgcacucagaacagacuaucgaagcaaacggaaacugauccaacgauuccuccugagacgcgaacgccuccauaggguccucaacguacuagacuucuugcccaagcacuacgcggaaagcaucgacuucgaaaaguaccucggaaaguuccugccaaacacagaacccaaacucgucuacaaccagaaccaguucaucuuccagaacagcuucuucgagaugcucaaagaauuucaagagaagcaccccgaacuauuccucaacaaccagaagaucccauacgacuggacuaucuacuaccuacgcaagaaagcccucucccagaaaaucgaaaaagaggaacuugccuggcuccuacuacaauucaaucagaaaagaggcuacaaucaacuacgagacgaagaagaggaaaacaccccagacaaacucgucgaguuuuacucccuaaaaauaaucaaaguuaccgccgaugaagccaaggagggcaucaacaaacgaugguacucaaucaaccuagaaaacggguggaucuacagacgcgagucgaaaacgccccuguucaacugggagggcaaaaccaaaaacuuuaucgucaccaccgaucuaaaccaagacggcucgauaaagaaagauaaagaggguaaagagaaacgauccuuccgcgccccauccgaaggcgacuggacucuucucaaaaagaaaaccgaaaaggagaucuacgaaucaggaaaaacccuagguaccuacauauacgacgcacuccuuaacaacccugaccucaagauuaaaggcgcccucauuaagacuauagaccgcaguauauacaaggaagaacuacagcagaucaucaacaaacaaaaagaauaucacagcgaacugaauaacuccaagcuauacaaagccugccucgaagaguuauaccccaagaacgaaaucuacaagaacgagcuaaagaacaaagauaucgcguacuuauucaucaacgacauacucuacuaccagcggccccugaaagcucccaaauauaacauagggaaauguucauacgagucacggaccuucaaaaaggaagacaagaaaaucaccgaauuuauccccgccguggcaaaaucacacccacuuuuccaggaguuccgccuguggcaguggaucaaaaaccucaaaauauacgaaaagcuaaccaacgauaacuacaccgacuucuuccucacuaacgaaagagacaucgaaaaauuauucgacuuccuguggaacaagaaagaaauagaccacaagggaauacuggaauacuuaaucaaaaccaaauuuccagaccucaagccuaaacaagucaaaaguaaagucaaagaauauagauggaauuauauauaugaccacgaaaaagacgaauccaaaaacuacccaugcggagaaacguacuuccuccucaaaaauaagcuggauaaaaucacaucaauacaagacgacuuccucaacaagaaacggcucgaaaaccuguggcacaucaucuacuccgucaccgacaaaaagcaguacgaaaaagcacuggcaaaguuugcgcuaaagaaccaguuagacacaaaauccuucguaaacacauucaaacgcauccccgccuucaaaaacgacuacgcaaucuacagccuuaaagccauaaagaaacuccuaccccuuaugcgcguagggaaauacuggaacuacgaugauauagacccaaucaccaaacagaagauccaaugcauaauaaccggagaagaaaacgauacaaucagcacauuaguacgcgagaagaccaaccacuucucaaaugagaacgacuuuaagaaccugagccuuuggcuagcaggcuacauaguguacaacagccauaacgaaaguuccgagaucgagaaguggaaaagcccccaagacauagacacauuucuuaagaaauucaaacaacacgcucugcggaauccuauagucgaacagguagugaccgagacacuccgaguggugcgggacaucuggcugaagaagggccagggaaagaaagauuucuucaacgaaauacauaucgagcugggcaaagaucucaagaaccccguagacaaacggcgcaagauaagcaguaccaacuccaaaaaugaaacaacaaacaucagaauaaaggcccuacugaaggaguuacugaaggaaggcauugagaacaucaaacccaacucaccgaaacaacaggaaauacuuaagauuuuugaagagggcauccuaaacagcggcaucgacauagaggaggaaaucaucaaaaucagccagaucgcccaaccgacgaagaagcaacuccaauacuaucggaacuggcuagagcaaaaguacaucucgcccuauaccggacaauuuauacccuuaaguaaacuguucacguccaaguaugagaucgaacacaucaucccacgauccaaauacuaugacgacucccucagcaacaaagucauaugcgagacagagaucaaucgacucaagaacaaccaacuagguuacgaguucauaaacaaccacgaaauccgagaaauaaccuuggaagaggggaagacaaucaggcuacugagcccgaaacaauaccuggacuucgugaccaccuacuacggaaagaacaaggccaaacgcgaaaaccuccuccucaaagagaucccaauacagaugauagaaaaucaacucaacgacacacgguacguauccaaauacgucaugcaacuacucagcaaaaucgugcgaaaggaagacggcacggacaauggcaccaacagcauuaauauauuguccgucuccggcaaaaucacucgagugcucaagaccgacuggggucuaaacgacgucuggaacgaccuccuguguuacagauuugaacguuuaaacaaaauaacaaacacuaaucuauucaccacauacagcgagcagaaacagaaaauaauccccaucgugcccgaccaauacgcaaaaggguuccacaaaaagaaacuggaccaccggcaccacgcccucgacgccauacuaauagcgugcaucacucgaaaccacaucaacuauaugaacaaccagaacauccaaggcgaaaaacucaaaaacuuuaaaaucgacaagcauaacuaucaugagauauuccagaaaucgcgacucgacaugcgcgcacaacucugcgagaaaaaguauaacgaccacgacagcacaaaauacacaugggucuucaccaaacccugggccgacuucaccgaaaacauuaaagacacacucgaguucaucaucccaucuuucaaacaaaaucuccgaauuaucaacaagacgguaaacuacuacgaaaaguacaacgaaaacgggaagaaagugaagguccggcaaaccaaaggcgacaacugggcaauccgcaagccacuacacaaagaaaccauaucagguaaaguccaccuacuauacaagaccccugcgaaaggaaagauccucacagccacccgaaagguacuggacagcuccauggauuucaaaucgaucgagaaaaucaccgauacuggaauacagaaaauccugaaaaacuaccuaaaguacaaagaaagccccgaacucgccuucuccccggagggcaucgaggaacucaacaucaccauagcaaaguacaacgacgguuucuaccacaagcccaucuauaagguaagaauauacgaggagggcguaaaauucccccucggcaaccgcggcaacaagaagaacaaauacgucgaggccgagaaaggaaccaaccuauucuucgcaauuuauaaagaucaggaaaacaacagauacuucgaaaccaucccuuucaacgacguucuagaaacccugaagaaagggauguccgcagucccagagaaaaaccaggaaaagaacacucuaguuuucgcguugaguccgcaagaccucgucuucgugccaacacucgaugaaauugaaaaccccgauauagucgacuuccgcaaccugaccaaagaucaaaccaaccgcaucuacaagauggucuccagcucaggaaaacagugcuucuuuaucaaggcagaaguagccaccuccaucgucaacaaaauggaguucaccaccagcaacaaaauggaaaacagcauagaagggauccagaucaaaaguaacugcuggaaacuaaagcucgaccgccugggcacuaucacacgcgucaucaaauga

SEQ ID NO: 6868 - RNA, 4389 nt, Artificial Sequence
  Cas9 variant
augacgaaaaacauacucggucuagaccucggcacaaacucaauaggcugggcacugaucaaacaaaacuucgaaaauaagcagggcgaaauccucggcaugggauccagaauuauacccaugucgcaagacauucugggcgacuucgggaaggggaacagcgucucgcaaacagccgagcgaacgaaauacagaucggucagacggcuacgcgaacgcuuccuacuacgacgagaacgacuccacaggguccucaaccuauugaacuuccucccccagcacuacgccucacaaaucgacuuugagaaacgauucgggaaauucaaaguugaaacggaacccaaacuggccuggaaaaacaucgacgggcaauucaguuuccuguuccaaaccucauucaaugaaaugcuggaggauuuccgcguaaacggacaagacgucaaaaucccguacgacuggacaauauauuaucuccgcaagaaagcccuaagcaagaagaucgaaaaagaggaacuagccuggauucuccugaacuucaaccagaaaaggggauacuaucaacuccggggcgaagaagaagaagagaaccccaacaaacucgucgaguucuacucccucaaagucguagacguuguagccgacgaaccacaaaagggcaaauucgacaucugguauucacugauccuagaaaaugggugggucuaccgacgcucaucaaaaaucccccucuucgacuggaaagacaaaacucgcgacuucauaguaacaacagaucucaacgacgacggauccauuaagaaagacaaagacgguaacgaaaaacggagcuuccgagcccccagcgagaacgacuggacccuaguaaagaagaaaacugaacaggagaucgaacaaucgaggaaaacggugggaacguacaucuacgaggcucuccuagacaacccgaaacagaaaauaaaagggaaacucguacgcaccauagaacgcaaauuuuacaaggaggaacuacgucaaauacuggaaaagcagaaagaguuccaccaggaacuacaguccgacgaccuauacaacgacugcguccgagaacuauacaggaacaaugaggcgcaucaacugacccucagcaaaaaggacuucguacaucugcuaauggacgaccugauauucuaccaaaggccacuucgcagccaaaaaucaagcgugucaaacugcacccuagaguuccgcaaguacaaggaugaaaauggcgcggaacacacgcaguaccuaaaggccaucccuaaaucgaacccguacuaccaggaauuucgccuguggcaguggaucuacaaccugaacaucuaucgccgcgaggaugagcaaaacccaaucacgggagaguuccuaucaacgaccaaggaauuugagaaccucuucgaguuccuaaacacucgaaaagaaguagaccaaaaagcgcuccucaaacacuucaaacucaacgacaaaacccacagauggaacuucguagaagacaagaaauaccccugcaaugaaaccaaaacuaugaucucgaguagacucgagaaggucgaaaacauuagcgacgacuuccucacucgugaaauagaacagaaaaucuggcacauaauauacagcgucaacgauaagauagaguacgagaaagcacuaaagagcuucgccaagaaacaccaccucgacgagagcuccuucuucgaagccuuucgcaaauuuccacccuuuaaaagcgaauacggauccuuuagugaaaaagcaguuaagaaacuccucccauuaaugcggcuugguaaauacuggaacuacgcggacauagacaaaaguucaaaagagcgcauccagaagaucauuagcggagaguacgacgaaaauaucaaagaccgaguacgggaaaaauccguccaccucacuaccgaaaacgauuuccagggcuuacaacucuggcuagcccaguacaucgucuacggcagacacuccgaagcgagcaugauaggcaaguggaauagcgccgacgaccuagaggaguuccugaaaaauuucaagcaacacucguugcguaaucccaucgucgagcaggucauaacagaaacccuacgaguagucaaggacaucuggcucaaauacggaaacggggccaaggacuucuucaacgaaauacacaucgaacugggccgcgaaaugaaacuacccgccaaagagcgggaggaccucaccagaaaaauaaccgaaaacgaaaacacaaaucugcgaaucaaagcacuacucgcagagaugaugaaugacagcuccgucgagaacguccgcccauucagccccaugcaacaggaaauacucaaaaucuacgaagacgggguauuaaauuccggcauagaaauagaagacgaauaccucaaaaucagcaaaaccgcccagccgucgcccucugaccuuaagcgauacaaacuuuggcucgagcaaaaauacaaaagcccguacacuggccaaauaauacccuuaaacaaacucuuuacgccugaauacgaaauagaacacaucaucccccaaucgcguuacuucgaugacuccuucuccaacaaaaucauuugcgagagugccguuaacaagcucaaagacaacuacaucggccucggcuucauaaaacaauucggaggcaccaucaucgaacuaggcuucggaaagagcgugaaaguuuucgaaacugaggaguacgaagacuucgugaaaaagcacuacgcgaacaaccgcagcaaaagaaacaaacuccuccuagaagacauuccagaaaagaugaucgagagacaaauaaacgacaccagacacauuagcaaauacauaucgggcguccucucuaacauaguccgaaucgacgaugaccaagccaagaagauaauagaagaugcagagauccucgcccguaaagagaucgauaaagacaaagcaaacgaaauccggagaaaagccaaaucccuagccacagacgacgggaucaacagcaaaaacauaguccccggaaacggaaaaauuaccacacaacuaaaacaggacuggggccucaacgacgucuggaacgaccucauccugccccgauucgagcgcaugaaccaacugacaaauuccaaagacuucacggucuggaacgaaaaccaccaaaaguaccugcccaccgucccaauagaguucucaaagggauucagcaagaagcggaucgaccaccgccaccacgcccuugacgcacugguaaucgcgugcgccacgaaggaccacguaaaccuacuaaauaaccaguccgccaaauccgacaccaagcgcuacgaccugaaaaagaagcucaugaaauucgaaaaaguugucuaccaccacacacaaacuggaaacaaaauugagcgggagauacccaaacaguuccugaaaccaugggagaacuucaccuucgacgccaaauacaaccuagagucgaucauugugucuuuuaaacaaaaccugcgagugaucaacaaagcgaccaacuacuacgaaaaguacgucgagaaggacggaaccaagaacaaaggccgcguggaacagacuggaacgaacugggcuauacgcaagccaaugcacaaagacacggucuccggaaaaguaaaucucccaugggugaaggucccaaagggaaaaauacucaccgcaacucgaaaaauacuugacacaucuuuugaccuuaaauccaucggaucgaucacugacaccgggauacagaaaauucuacgaaacuaccucgaguucaaagguucccccgaacuagcauuuuccccggaaggcaucgaagaccuaaacaaaaacaucgaaaaguacaacgacggaaaaccccaccaacccauuaacaaaguccgagucuuugaacugggcagcaaauuccaagugggacaaacggggaacaaaaaggacaaauacguggaagcggcgaagggaaccaaccuuuucuucgccgucuacgaagacaagaauggaaaacgauccuaugaaaccauaccccugaacgaagucaucgagaggcagaagcaaggccucucagucguggaucugaaaggaaccaacgacuucuacuugugcccuaacgaccucguuuauaucccaagcgacgacgagcucgagaacauuaacaacaucgacuucaagaacauugccaaggagaaaaaugaacgaaucuacaaaguaguaucguucuccggcucccagauauucuucguccgccaagacaucgcaacaagcaucgugaacaaagcagaacuuucaacccucaacaaaauggaacgcgcgauggacgguucgaugaucaaagaaagcugcguaaaacuuaacguagaccgguuaggaaauaucagcaaagcauga

SEQ ID NO: 6869 - RNA, 4401 nt, Artificial Sequence
  Cas9 variant
augacgaaaaauauccuuggccucgaucucgggacaaauagcauuggcugggcccuaauaaaacaggauuucgagaacaagcagggcgaaauccuugggaugggcagccgcauuauacccaugucccaagacgugcugggcgaauuugggaagggcaacagcguaagccaaacagccgccagaaccgauuaccgaggagugagacgacuacgcaagcgcuuccugcuacgacgggagcggcuacaccgcguccucaacgugcuuaacuuucucccggugcacuacgccucacagaucgacuucgagaaaagauuuggaaaguucaaagaggauaccgagcccaagcucgcauauaacaaagagggcuucauauucaaaaacaguuucgaagagauggucgcagacuuucgcaaacaccaaccucagcugcuggaaaacgacaagaaaauucccuacgacuggacgaucuacuaccuacggaaaaaggcucugucaaagaagauugagaaagaagaacucgcguggauccugcuaaauuucaaccaaaaacggggguacuaccagcuccgcggcgaggaggaagaggaaaauccaaauaagcugguagaauuuuacagucuaaagaucacagacguccuugccgacgaaccacaaaagggcaaaagcgacaucugguacucgcuaauucuagagaacggguggaucuacagacgaagcuccaagacaccacucuucgacuggaaagagaaaacacgggacuuuauagucacuacggaccugaacgaugacggcucgaucaaaaccgacaaagauggcaaugaaaaacguagcuuccgagcaccguccgaaaaugacuggacccuaguaaagaagaaaaccgagcaggagaucgacaagagccagaaaacggucgggaccuauauauacgaaacccuguuacagaacccgaagcaaaagaucaaaggaaaacucgugugcacaauagagcgaaaauucuacaaggaggaacugaaacagauccuagagaaacagaaggaauuucaccaggagcuccagaacgacgaucuauauuccgacugcguccacgaacucuaccgcacaaacgaagcacaccagcucacccuuucaaagaaggaaauaguaaaccucuuuauggaagaucucauauucuaccaacgcccacuacguucacaaaagacgaguaucucgaauugcacccucgaguuccggaaauacaaagacgagaauggggucgaacacacccaauuccuaaaagcaaucccaaaaucgaacccauacuaccaggaguuccgaaucuggcaguggaucuucaaccucaacaucuacaaaagagacgacgacucaaacgucaccaaagaauuucucaacacgacagaagacuucgaaaaccuuuucgaguucuuaaacaaccgcaaagaaguagaacaaaaggcccuacucaagcacuucaaacuuaaugaaaaacuccaccgguggaacuucgucgaagacaagaaauacccaugcaacgaaaccaaaacgaugauaaguacacgccuugacaaggucgaaaacaucagcaaagacuuuuucacgagagaaauagaacagaagauauggcacaucaucuauagcgucaacgacaaaauagaauaugagaaagcgcucaaauccuuugcuauuaagcacaaccuggacgagaacagcuucuucgaagcguucaaaaaguucccaccguuuaagagugaauacggcagcuucagcgagaaggccaucaagaagcuccucccacucaugaggcuagggaaauauuggaacgaagacgagaucuugaaguacagcgacgacuacuucaagaacaucgaaagccuccucggcguacugaaacagcgagacgaaaacauaagcgaugccgaccgcgaaaacuacaacaagacgaucaacaacaaacuucgcgcagaacucgaaaacuuccaaaacgccgaaaucgaaucguuccaggggcucagacuccacauagcacaauacauccuguauggcaaacacuccgaaggggacaacaaaaaguucaacagcgcagacgaccuggagaaauuccucaaggaguucaagcaacacucccuccgcaaccccauagucgagcaaguaaucacggagacacuucgcguagucaaggacaucuggaccaaauacgggaacggcgcaaaagacuucuucgaugaaauccacaucgaauuaggcagggacaugaagaaaacccgggacgaacgagcagacgccaccaagaucaucacggagaacgaaaauacaaaccuacggauaaaagcgcugcuagcggaaaugaugaacgacgucgaaauggagaacguacggcccuacagcccaaugcaacaggagaucuugaagauauacgaagacggaauacuaaaguccgacaucgagaucgaagaugacauacucaaaauaucgaaaaccgcacaacccagcaguucagaccuaaaacgguacaagcuauggcucgagcaaaaguacaaguccccuuacacaggccaaauaauuccacugaauaaacucuucaccccggaguacgagauagaacacaucauuccacaauccagauacuucgacgacucuuucucuaacaaaauuauaugcgagucggcagucaacaagcuaaaagacaacuacaucggccuaggcuucauaaaacaauucgguggaacaauaguagaauguggguuugguaaaaacgucaaaguguucgaagccgaagaauacgaggacuucguaaagaaacacuacgccaacaaccgaggaaagagaaacaaacuacuccuggaggaaauaccagagaaaaugauagaacgacaaaugaacgauacccgacauaucaguaaauacaucagcggcguccuaagcaacauagugcgcguagaagacggcucagacgaaggagucaacuccaaaaacaucgugccgggaaauggcaagaucaccacccaacuaaaacaagauuggggguuaaacgacguauggaacgaacuaauacucccgcgauuugaacggaugaaccagcuaacaaacucaacagacuucacagccuggaacgagaaccaccaaaaguuccuaccaacggucccaaucgaguucagcaaaggauucuccaaaaagcggaucgaccaccgccaccaugcacuggacgcccugauaaucgccugcgcgaccaaagaccacgugaaccuccuaaauaaccagagcgcaaagagcgacaccaaacgcuaugaucugaaaaagaagcucaugaaauucgaaaaaguaguuuacaaccacccccaaacaggagaccgcaucgaacgcgagguuccgaagcaauuccugaagcccugggacaacuuuacguucgaggcgaaaaacaaccuagacaaaauaaucgucucauucaaacaaaaccuucgcgugaucaacaaagcaacgaacuacuacgagaaauuuguggaaaaggacggcgucaagacgaaagagcgcgucgagcagaagggaaccaacugggcaauacgaaagucccuacacgaagaaaccgugucaggcaagauagaccucccauggguggaaacaaacaacggcgaguucaucaccgccacccggaaaucgcuagacgccucguucaaccucgagaaaaucaagaaaauaacagacacaggcauccagaaaauccuaagaaacuaccucaaagcaaaagacgacaaugcagaacucgcguucaguccugaagggaucgaagaccucaacaaaaauauugagaaguacaacgaugggaaaucucaucaacccaucgugcgaguccggguguacgaaaaagguaaaggcagguuugcgcucggccaaacagggaacaauauugacaaguacguacagggcagcccgaaccuauucuucgcuaucuacaaggaugagaacggaaagaaauccuacgaaagcauuaggcuagacauagugauugagcguaugaaacaggggcugcaagccguaccagaaacgaacccgaauggcauaucgcuguaccaaaaccuaucuccucucgaccucguguacauacccacagaagaugagaucgaaaguccccaccugaucgauuuuacaauccuuaacaagacgcggcuggagaggaucuacaacguaaacgauuucuccggcuacaccaucuauuucucccaaaacuccuucgccaagaacaucuaccccaaagagauggacaugacguggaacgaaaagaaacagaaacccucgggcagcuucgauucgaaaacagcaagcuacaacaagaaaucgauaaaagacaucuucauaaaacuaaaaaucgaccggcuugguaacauaaguaaagucagcaacacgcucuga

SEQ ID NO: 6870 - RNA, 4401 nt, Artificial Sequence
  Cas9 variant
augaaaaacauacucggccuagaucuaggaaccaacucuaucggaugggcacucgugaaagaagacuucgaaaacaagcagggagaaauacugggccucggcagccggaucauccccaugucgcaggacauccugggcgaguucggcagaggcaacucaauaucgcaaaccgcagaucgcacuggcuaccgugggguacgacgccucagagaaaggcaccuccuacgccgagaacgccuccaccgaguucucaacauacucggcuuccucccgaaccacuacgcaaaggaaauugacuucacaaaaaggcuagguaaauucaucaaccacgccgagccaaaacuuucauuugauaaggaguucaucuucaaagacagcuucaacgaaaugcugaaagauuuucagcaaaaccaaccgggcuuuauaauaaacaaacacggcgaagaagcccucgucccauacgacuggacuaucuacuaccuccggaagaaagcgcucacccagaaaauagacaaagaggagcuugcauggauccuacugaauuucaaccagaaacgcggcuacuaccaacugcgcggggaggaagaagaggaaaacaccaacaaacuugucgaguucuacucucucaaaaucauagacgucaucgcagacaacgaagugaacaagaaaggagaaguaugguacagccuacacuuggagaacggguggaucuaccgucguuccuccaaaaucucccuugucgauuggaaagacaaagugagagauuucaucguaacaaccgacgugaacgacgacggguccgaaaaacuagacaaagaugggguggucaagcgcagcuuccgggcgccaagcgcggacgauuggacccuguuaaagaagaaaacagagcaggacaucgacaacucgaacaaaacuguaggggcguacaucuacgagaaccuacugcuuaacccaaaacaaaagauaaaaggcaaacuuguacgcaccaucgaacgcaaauucuacaaagacgagcugaaacaaauacucgaaaagcaaaaggaguuccaccaagaacuccaaaacgaacaacuccuccaggacugcguccgcgagcuguacaaauacaacgagcaacaccaacaaaugcuggagagcaaggacuuuguucaccuguuccucaacgacaucauauucuaccaaaggccacuacggagccagaaaucacuuaucuccaauugcacccucgaaaaacgcgucucacgagacggcgugguguuuccaauaaagguaauaaguaaaagcaacccguacuaccaagaguuccggcuccuacaauggcuccaaaaccucgcuaucuaccgcaaggacgacgacguaaaugucacccaagaguuccugaacagcaucgaauccugggaaaaccuccuucaguuccucaacgcuaagaaagaaauaaaacaggagcaacucaucaaguuccuacuagagcagaaagggcucaagggaaauucccugaaaaccgcaauccuuaccuaccgguggaacuacgucacggacaaggucuaccccaugaacgaaacacggucccuaauacaagacaagcucaagaaaguagaaaacguggcgacagauuuccucagcuucgauaacgagauggcauuguggcacauaaucuauaguguaaaugauaaaaucgaauaugaaaaagccuuagcaaaauucgcaagcaagcacaaccucgaugaaaucagcuucguagagagcuucaaaaaguucccacccuucaagagcgacuacgggucguucucggaaaaagccauaaagaaacugcucccccugaugcgguucggcuccguauggaauaaaaacaacaucguacccagcguauuggaccgaauagauaaaauccuuacaggcgaauacgacgagaaaauaaaaaucagaguacgcgaaaaagcagaacaauuccaguuaaaccaaauagaagacuuccaaaaccucccccucuggcuggcacaauacgugguauacgacagacauagcgaagcggaaaucgcgggcaaauggaacagcgugaaagaccucgaaaacuaccucaaagaguucaaacaacacucccuucgcaacccgaucguagaacaaaucaucaccgagacccuccgaguagucaaggacaucuggcaacaauacgguaauggcguucaaaacuucuucgacgaaauccacauagaacuaggccgcgagaugaagaacacagccgacgagcggaaacgcauaacaaacucagucacagaaaaugaaaacacgaacuugcgcaucaaagcgcugcuaguggaauugaaagaagacaccaauauugaaaacguacgcccacacuccccuaugcaacaggaaauccucaagaucuacgaagagggcgugcuaaaugcuguagagaacauugacgaggacauccuaaaaauaucgaaaacugcacaaccgucaaagucagaacucauacgauauaaacuauggcucgaacaaaaauaccaaagccccuacaccggggaaaugaucccccucucccgacucuucaccucagacuacgaaauugagcacgucauaccccaauccagguauuucgacgacucccucucgaacaaagugauaugcgaagcugccguaaauaagcgcaaagacaaucaacucgggcuggaguucaucaaaaaccaccacucagagaaaauugaacucggcaacggacguacggcccagguacuugaaguggaagcauacgaauccuucgugaaaaagaacuacgacaagaaccggggaaaacgcaacaaguuacuacucgaagauguacccgaaaagaugaucgaacgccagcucaacgauacgcguuauaucuccaaguucgucacccaucugcucuccaacaucguacggaaggaugaagugaauagcaaagaugauggaauaaacaguaaaaacaucauaccgggcaacgggaaaauaacaucacaacuuaaacaggacuggggccuuaacgacguauggaacgaauuaauacuuccucgguucgaacgcaugaacaaccucacgaacucgacagacuucacauccaccaacaccaauggcaaaauaauucccacagucccacucgaauacaguaaaggcuucuccaagaagcgaaucgaccaccgccaccacgcacuggacgcacucgucaucgcccucgcaacgcgcgaccacgucaaccuacugaauaacgaauccgcacuuccgaaaaaggaccgaacuaaggaagaacaaaagagcuucagguucgaccuacagguaaaccuccguaacaaagaaaaauacuucaacgucaaagaaggccgcgagaaagaaaaauucaccaccuucaagaaacccuggaacacccuaacacaagacacgcgggaugcccuagagaacauggugguauccuucaagcaaaaccugcgcgucauaaauaaagccacaaacuacuacgaaucauacacugacgaaaacggcaaccuucgccuagacaaauacgggaaccccaagaaggaacuaaucagccagaaaggaacgaacugggccauaagaaaaucacuucacaaggaaacugugucaggccaaauucaccuugaccgaguaaaagucaccaaaggcaaaaucgugaccgccacacguaagagucucgacagcaguuucaacgagaaaucgaucgaauccaucaccgauaccggaauccagaaaauccugcgcaacuaccuaaaagcaaaagacaauaagcccgacguagcguucaguccagaaggcaucgaagaacucaacaaguccauauccgucuauaacgaaggcaagaaucaccaaccaauaauaaaagucagaaucuucgaacaaggcucaaaauuuccgguaggagaaacaggcaacaagauagccaaguucgucgaagcagccaagggcacaaaccuauucuucgggauuuaucaagauaaaaccggcaagcgcucauaugacacaauaccacugaaccuagucauugagcgacuaaagcaaggacuuaguccagucccugaaaccaacgagaagggacaccagcuacucuuccaccucagccccaaugaccucgucuacgugcccacaaucgacgacaacgagcaacucgacuccaaccgcgucuacaaauucacagacagcagcgacacaaccugcaacuucauccccuccaacaucucagcaauaauauucaacauuaauucaaaagagcaagagaaaaggggcaucaauuacccgauacagaaugaauuaggcgucggaagcccacaaucgaagaaccaaaagagcuucgacggguucaugaucaaggaaguaugcauaaaacucaaaguggaccgacucggcaacauuaguaaaaccuga

SEQ ID NO: 6871 - RNA, 4416 nt, Artificial Sequence
  Cas9 variant
augugcaaauacuucuacaucaaaaacuuuaucacguucguacuaucaaaaucgaucaucccaaugaagcacauccuagggcuugacuuagggucuaacucuauagguugggcguucgugcaacaggacuucgagaacaaacaaggaaaaauaauugcaaccggcagucgaaucaucccaauggaccaaggcauccucggagacuucgaacgcggaaacaccguaagccagacagccgaaagaaccacauacagaucgacccggcgcuugcgcgaacgccaucuacuacgcagagaacgacuccaucggguccuucauauacuuggauuccucccaccccauuacgacgcgcaaaucgauuucacaaaacgcuacggcaaauucaucgacaacgcugaacccaagaucgcauacaacaacggcaacuucauauucaugaacuccuucaacgaaaugauagaggacuuuaagaagcaccaaccacaacuguucuacaagaaaucgaauggcgaagaaagcaaaaucccauacgauuggacuauuuacuaccuccggaagaaagcacugagccagaaaauaacucaacaagaacuugccuggcucauacuacacuuuaaccaaaagcgagguuacuaccaacuccggggagaagaagaaaccgagaauccaaacaaagagguggccuuccacagccucaagguaguggacguggaagcugaggcgcccaacaagaaaggggaaaucugguacaccauccgacucgaaaacggauggauauaucgacggacaucgaaaauaccacucgaugacuggaaaggcaagaccagagacuucauagucacaacagaccucaacgacgacggcacaaucaaaguggauaaggaaggcaaagaaaaacgcucauuccgggcccccgacgagaaugacuggaaucuacugaaaaagaaaacagaacacgacaucgauuucucagggaaaaccgucggcgccuacauauacgaccaucuccuccagaacccgaaccaaaagauaaaaggcaaacucguccgcacuauagagcgcaaguauuacaaagacgaacuaaaggcgauacuagcgaagcaaaucgcccuccagccagaacucuucacagaaacccuuuuggcugacugcauucgcgagcuauaccgaaagaacgaaacgcagcaacagaacuugcuuagcaaagacuuccuacaccuauucguagaggacaucauauucuaccaacgaccccugcgcagcaagaaaucaacaaucgccaacugcacccuagagaaaagguccuacauugacaaagagacuaacgagagaaaagacgccccgauuaaaguaugcgccaaauccaacccauacuaccaagaguuccgaguacuacaauggcuccaaaaccuacggaucuacgaaaucgagacugaccgggaaguaacggccgaguucaucgaaacaccccaggacugcgaagcccucuucaacuuucucaugucgcaaaaagaaauagacaauaaaggacugcugaaauacuuccucuucgcgaaaaacccccaaaucaaggauaaagcagcuaaaucggaacugaagaaauggcucaccaccuaccgauggaacuacguguacgacgcagccgacaacucuagcaagaaauaucccaugaacgaaaccggauacgaauuacaacgguaccuacagaaagucgagggacuacccgcaaacuuccugaccuucgacaucaccuaccaacucuggcaucuccuguacucggucaaagacaaagucgaguucgaaaaagcccucaagaaauucgccaaaaagaaacagcucgacaaaacgagcuucguagacuccuucaaaaacuucaaacccuacccaaacgaguacggcagcuucagugagaaggcgauaaagaaacuacuuccacucaugagguucgggaaucacugggacuucaaccgcaucgauguuuccacacagaaacgcaucgacgaccugauaaacggaguggccaacgaagacauccgcaccaucaucagagaaaaggccgagaaguaccagcuuaacuccgagacguguuuccaggaccuaccccuauggcuagcccaauacgucguauacaaccggcacgcggaagccaccgauauagaaaaauggacuagcguaagcgaccucgaggcuuaccuugaagacuucaaacaacacucgcuacggaauccaaucgucgaacaaguugucaccgaaacacuacgggugguaagagacaucuggcagcaauaugggggaggacaagccaacuucuucgacgaaauacauaucgaacucggaagagagcucaaaaagacagcagaggaacgaaaacagcucagcgauaaaaaccaggaaaacgaauccacuaaucugcgcauaaagaagcugcuugccgagcucaaagaggaugccuccauccagaauguccguccauacagccucgugcagcaggaacuccucaaaaucuacgaggaaggugucuucagcgcaaccgacgaaguugaggaggacauacagaaaauccgaaagaaagcggaacccucgaaagcagacuuacaacgauacaaauuguggcucgagcagaaauacaaauccccguacacgggggaaguaaucucccugacuaaacuauucacagaagaauaugagauugaacacauuauaccacaaucccgauacuacgacgacucucucuccaacaaagugaucugcgaaagcgcaguaaacaagcugaaaaccaaccaacuaggccuagaguucauccaaaaccaccauggagaaaagguccgaaucaccgccaacaaagaggucaccaucuuuacagaggaacaguacaaagaguucgucaagaaacacuacgccaacaacagcgcuaaacaacaaaaacuacuccuuaacgagauuccagagaaaauggucgcgcgucagcucaacgacacucgcuacauauccaaguacaucagcgagauccuauccaagauaguccgcucugacgaaaaggacgaaggagucaacuccaaaaacauaauccccugcacaggaaaaaucacgaccgcgcuaaaacaagacugggggcucaacgaugucuggaacaaacuaaucuuacccagauucgagcgcaugaaccaacucacccagacacaacuauuuacuucauacaacgaccgccuccagaaaaaccucccgacuguccccaucgaauacucacaaggcuuccaaaagaagcgaaucgaccaccgacaccacgcaauggaugcccugguaaucgccugcgcgacacgggagcacaucaauuacaugaacaaccaacacgcauuagacaagucaaaagauaagaaagaaaaacaacagucccgcauagaccuacgcaccauacuaugugagaagaaaaacaacaacuggcaguucaagaaacccuggagcaccuucacacaagaagcaaaagaagcccucgaacacaucguaguaucguucaaacaaaaccucagaguaauaaacaaagcaacgaacuacuacgaaaaaugggaagagaaaaacggaguccuagucaaaaagaaagucaaacaagaagggacaaacugggcgauccgcaaaccacuacacaaagagacggucagcgguaaaauaguacuugaucgaaagauaggcaaagauaaaauccuaacagccacgcgcaaagcggucgacauaacguucaccgagaaaaucaucagcucuauaaccgacacuggaauacagaaaauacuucuaaacuaucuaaaguacaagggcaguccggaaguggcauuuucgacagaaggccucgaggaacugaacaaaaacaucgcccaauacaacaauggaaagaaacaccagccaauauacaaaguacgaaucuucgaagaaggauccaaauucccccucggcgaaacuggagccaaggccaccaaguacguggaagcagccaaaggcaccaaccuauuuuucggaguauaccaaggcaaaggcaaaagaaccuacgcgaccauaccgcucaacgaagucauagaacgccagaaacaaggacugccgagcgucccugaacgaaacgagaagggcgagccacuacucuuuagccuaucuccuaacgauuuagucuacgucccaauggagggugaaaucgccgagaccaucgacuucaacaaccucuccaaagaacaaaaagaacgcauuuauaaaacaguuuccuucaccggcaaccaaugcuucuucguacaggaggccgucgccacccccaucguaaacaagauggaauacuccccgcuaaacaaaauggaacgcgacauccuuggcaccaugaucaaagagguaugcaucaaacucaagguugaccgacuugggaacaucacgaaagccuga

SEQ ID NO: 6872 - RNA, 4416 nt, Artificial Sequence
  Cas9 variant
augggcuacaaggcgcccaggaacgacaagggggaaauagacuacggcgucggccucgaucuaggaaacgguagcguuggcuggguagccauggacaaggacuaccaccucauccgagcaagaggccacgaacucaucggagcacgacuauucgaccccgcuaacagcgcagaaaaccgacgcgaaucaagaaccacucggcgcagacucucacgcagacgcuggcgccuacgaaugcuagauagcuuauucgcaucagagcucgcgaaaauagaccccaauuuccucgcgcgccgcaaguacucguggguacaccccaaagacgaacaaaaucacgaaaacugguacggcaguauaaucuucggaucgaaggaacaagacaaacaauucuacaaggauuaccccaccauauaccaccuccggaagaaacucaccgaggacacugaacgccacgacauaagagaaaucuacgucgccauacaccacaucgucaaauacaggggccacuuucuaagagagggagaaaucaacagcgaaaaucucuucgacccagagggauuuguagaacucauaaaagacgucauaaaauugaauaacagcuaugacgaauccacaccaauauuugaggcaagcccugccgacguaagcgaggcguugcugaacgaacacacaucccgcuccggcagaaucgaagacacacucgacaaacuagauuucagcguaagccgcgucgacaaacaugagcucaaaggaaugcgcgacgccgccaaagcagucauuggcgccaucguggguaacaccgcagacuucuccaagaucuucaaccucgacaaucuagacaaagacuccaaagacaaccugaaacuaaaguucgccgacagcaacuucgacgaaaaauacgguggcgucgugggcuccggacuccuugacgaaacccaaaucgagcuagucgacaggauacaugcggucuaugacgcaguggcccugaaggggauccucggcgacgcucacaccaucucagaagcuaaggucgaaaguuacgaaaaacaucggaaaaauuggaaacucauaaaagaagaacuucgcacaaaagagaacaaagacgaggucgaucucugguacggugaccuuuccggaaggcaauacaaaaacccaccggacccagaaaagggacccgacgaaggcagcaagaaagacagcccgauccgcgauucagaucagaagcaaaaccugauuaagaaagccaacgacuacuucacggagcucauagacgacucacaacucucagaagaacaaaagaauugccucaagaacgacauaaauaacggacaacuauucccaguacagcggagcucggacaacggcguaaucccauaccaaauacaccuaaaugagcuccgacggauuauagagaaccagaagcaauacuauccauuccucgccgaaaccuuuauucgcaaaacagcggagggcaaaaguuacgaagagaacaagaucguggcccuucuuaaauucagagucccauacuacguugggccgcucgucuccaaagaagacauggaggaacacagcucaggcaacuccgcuuaccacuggauggcacguaaucccggccgaggagaggcaaucacccccuggaauuucgacgagguuguagacaaagacgaaucaggcgccagauucauaagccgucucacgggcacagauacauaccucuugggggaacccacacugccccaacacucccugcucuacgaagaguacaugguccuuagcgagcuuaacaacgugcgccuuaacguaagacagggaaaccacuggagcgauaaaaaccgccaacgacuuucguacaaacaaaaagaguuccucaucgaaaaccuauucaaagaacacaagaccguaacccgcaaacgggcagaggacugccucuccagcaugggcugcggcgagguccaauuauucggacugucagacgagaaaaaguucgcauccagccuuagcagcuacaucacucuuaaaaagauacuaggcaaagcguucguagacgacuccgggaacagugccaucuuagaacguauuauagaagugcaaacgguauucgaagauagagaaccacucacccaccaacucagccucaucgacucguuaaccguagaacaaagaaaacagcucgcaaagauucacuacacaggcugggggaagcuauccagaaaauugcuaaccagcaaaaaggguucauacaaaauccacucgcaaaacgaaauuaugagaacacaacauagcaucaucgacauaaugcgaggggacagccuuaauuugauagaaauaaucagggacaaaaagaucggaaucggagaguggauagacaacgaaaaccuagacagagagaccggagaguccgauguuagcagacuagagucagucuucgaaggaaucgugauguccccaagagucaaacgaggaguaguacaagcaguccgcguaauagaugaccuggccaaggccauaggaaacccgccgcaaaggauauucauagagauggccgacgaaguacaagcuagucaaagaacugucuccagacugucccgucucaaagcgcucuacgggagcccaucacuacagaaggaauuuaaugaccucaaagaucugcgaaaaucgcuuaacgagaccaaagaugcagaccuccaagaagaccgccuguaccuauacuacauacaacuaggcaaagaccucuacacaggcaaggaaaucagcaucgacucucucagcagcgcauacgacauagaccauauaguaccacaagcacucacucaagacgacagcauagacaauagggugcucguaagcagaaaagaaaacgccagaaagaccgacuccuaccuauacacacccgaucucauaaagaacaugcgaccccucuggggcaaacuacuggcagccggcuuaaugucgcaaaagaaauacgacgcacugacgcguguagacgacuucaaagaccgggaaaaacagcgcuucguacagagaucccugguagagacgaggcagauuaugaaaaaugugucaaccauacugcgaaccuacuacggagaagacaccaacgucgugacccuaaaguccagcaucacccacgacaugaggaaauaccugggcuucccuuacaaaaacagagacaucaacgacuaccaccaugcccaggaugcucucugcauaagcgcggcaggccaguucaugcugaaccgucacuucgucucaggcggggagguuacggacggggccucaaacgcguauaacauguaccucgcggaauacuuacaagaauuucgagacgccaaagcacgaggagaacgcaaacgaucuaccgcauuuggcuucgucgucgggagcaugagcuccaaggacgacgaaaagcguacggaccacagaacaggugaaauugucuggucggagacaaacgccgaguaccuacgaaaagucaugaacuauaagaaaaugcugauuacucaaaaggugggcgacgucaaaacccgagcacucuacgacgaaacccgcuacgggcauaaagagucaagcgcaaaaucaauaaaguucgacaaccuacgacgggacacgucauuguacggaggcuucuccggagcauccaccgcguacaugaugcuagucgaguacaagaagaaaaauaagcucguaagcaucaccgcacaagaagccucacuucuggcaguagccgaccagaaaaacgacaccguaagcguaauggaugguauccuagcgucccacggccuaucaggcgcaaagauccuguugccaaagaucgugaccgggcaacuucuggacuacagcgacgcacucguaacgcuacagagugcaagcgaacucaacacggcaagacaaauguggcuucccaggaacgacuacaacgacauugacaucauccuaaaguccaaagacaucgaggacgccgcccacaagcugggguacgacagcgacaccguacacguacugaggagaauccaaaagcucuuugaagccgucuuuagaguagcggagucacaauuuccccuccaccaacuaagcaaagaccaacaagaagaaauacuaagagacccucaaaacuacggguucggaagcgcggucaaauuacugggcggccuccugaaagcacuccacgcgaacgcagagaacacuaaccuggcaggccugguaaaaguacugcauggggauaaggaauacagcgacgauggcaaagcgaaagaguucaagaaauucggauucucgcccagauggagaagaauaaguaaccccaccggcuucacacucuccgacucggacaccuucauauaccaaagcccgagcgggaucuucgaacaacgaguaaccgucaaagaacuuaaagaaaaagcggacaagcaaaaauga

SEQ ID NO: 6873 - RNA, 4422 nt, Artificial Sequence
  Cas9 variant
augaagaacauacugggccucgaccucggcacaaacaguauagguugggcccuaaucgagaaagauacugaccagaagaauggaaacauacucggaacgggaagccgcauuauaccaaugagccaagacauaaaggacgaguucgggaagggcaacuccauaagucagacugcggaucgcacaaaauuccgcagcguccgaaggcuccgagaaagacaccuacuaaggcgggagcggcuccaccgagugcucaaugugcugggauuccuacccaaacauuacgcagaccagauagacuuuaaaaagaggcuaggaaaacucgugaaugaaaccgagccaaaacuugucuacgauaacaagaacuucauauucaaaaagagcuuugaggcaaugcugucagauuucaaccaacaccagccccuccuccuggcggacggcaagaaaguucccuucgacuggacgauauacuaccuacgcaaaaaggcgcucaccgaaaagauagaaaaagaggagcuagcauggcucauccucaauuucaaucaaaaacggggauacuaccagcugcgaggcgaagaggaggaggaaaaccccaacaagauggucgcauuccacucacuaaaaaucgucgaggucaucgcagacgaaucccaaaagggcaaagccgaaaccugguacagccugauucuugaaaauggauggaucuaucgacgauccucaaaaacaccccucuacgauuggaagggaaaacaacgggacuucauugugaccaccgaucuaaacgacgacggcagcauaaagacagacaaagaaggccucgagaaacgcagcuuccgggccccgguagaggaugacuggacauuagugaaaaagaaaacugaacaggaaauuaaccgcucccacaaaacgguuggcacauacaucuacgaaaaccuacuccaagacccaaaacagaaaaucaaggggaaacucgugcgcacgaucgaacgagaguucuauaaggacgaacuaaaaaugauacucaagaaccaacaaaaauuccaccccgaacugaaugacgaacaccucuacauuaacugcgugcgugaauuguaccgcaacaaucaagcccaccagacgauucuaaguaagaaagauuucguccaccucuuuaucgacgacaucauauucuaccagagaccccuccgcagccaaaagucuucaauuuccaacugcaccuuggaguuccgcaaguauaagaacgaaaacgggacagaucagacagacuaucucaaagcaauaccaaaaucgcauccucuguuccaggaguuccgacuuuggcaguggaucuacaaccucggaauauaccagaaagaagacgacaccaacguuacugacgaauuaaucaaaaacauagacggcuaccaagaccuguucgacuuccucaacaacaagaaagaaauacgccaagacauccucaucaaauuccucgucgagcaaacgggccuaaaaggcaaaccccucuccagcguaguagccaaauaccgauggaacuucgucgaggauaaaauauacccuugcaaugaaaccggcacgcaaauacgcacacgccucgccaaaguggagaacacgccagaagacuuccuaacugccgaaacugaaauaaaacuuuggcacaucauauacagcgucaacgacaaagcagacuaugaaaaagcgcuuaaaacauucgccgaaaaacacaaccuugacacacacuccuucguagagaacuuuaagaaguucccacccuuuaaauccgaguacggauccuucagcgaaaaagcaaucaaaaagcuguuaccacuaauacgucucggcaaauacuggagcugggagaacauagacaagaagacccaagaacggaucgaaaagauccuuacgggcgaauuugacgaggcuaucaaaucccgcgugcgagauaaagcgauacaccucaccgaagaggaccacuuccagggucuacagcuguggcuggcuagcuacgucguauacggccgucacagcgaagcagacaaccuagacaaguggcacacagucgcggaccuagaggacuaucucgccgaauuucgccagcacagccuacggaacccuaucgucgaacaaguaauaacagaaacacuccggguugucaaggauaucuggcuacaauacggccagggugcaaaagacuucuuuuccgaaauccauaucgaacucgcuagagaaaugaaaaacaccggcgacgaacgcaaacgccucacaucccucguaacagauaacgagaacaccaaucuccgcaucaagguacuccuaucggagcuccucaacgacggaaacguggagaacguacgccccuauucccccaugcaacaggaagcauuaaaaauauuugaagacggagugcucaacagugacauugaaaucgaagacgauauccuaaaaaucucuaaaauggcucaacccaccaauacagaacugaaacgcuacaaacucuggcuagaacagaaguaucgcagcccauacacuggacaaauaauaccccucaaccgccucuucacagccgacuacgaaauugaacauaucaucccccagucgcgguucuuugacgauucguuuuccaauaagaucauaugcgaauccgccgucaaucaacugaaagacaagcaacucggacuagaguuuaucaaaaaccacaguggcaccaucguaaaacuaggaaugggcaagacggcaaagauacuugacguggaaagcuacaacgaguucgugaaaggaaacuacaccaaaaacaucuccaagcggaacaaacucaugcuagaagaaauccccgacaaaaugaucgaacgccaguuaaacgacacccgguacaucucuaaauucaucaucagcgcucucagcaacauagucagaucggaaucaaacgacgacggcuucaacuccaaaaacguccucccaggcaacggaaaaauaacgagccgccucaaacaagauuggggcaugaacgauauauggaacgaauuaauccucccacgguuugaacgcaugaacaaaaucacggacagugcuguauuuaccgcguggaaugaaaacaaccagaaauuccuccccaucguuccgcuagaguucucgaaaggauuccaaaagaaacgcauugaccaccgccaccaugcacuugacgcccuggucauagcagcgucgacacgcgaacacauaaaccuccuaaacaacgaacacgcaaaaagcgacaaacgcuuugaccugaaccgcaaacuacgcaaguucgaaaagguagcauauaacgauccaaaaaccgggaaacgcaucgaaaaagaaguaccgacaauauuccuaaaaccgugggaaaccuucacagucgacgcgaagaacucacucgaaucaauuaucgucagcuucaagcaaaaccucagaguaaucaaccgcgcaaccaacuacuccgaauccuacaacgacgagaacggggcacuacgccucggcaaggauggcaacccacucaaggagaaaauaaaacaauccaagggagacuccugggcaauccgcaaaccuaugcacaaggacuucguuuacggcaaagugcaucuccagaacgugaagcuccccaaagacaaauuuaucaccgcaauccgaaaaucccucgacguaacguuugaucuuaagcgaauagagaccaucacugacacgggcauccagaaaaucuugaaaaacuaccuucauagcaaggagaacaaagucgaacuggccuucagccccgaggggauagaggacaugaaccaacacauagaaagauacaacgacggaaagaagcaucaacccauacacaaagugcgcguguucgagauagggucucgcuucucccuuggagaaagcggaaacaagaagaccaaauucguagaggcugccaagggcaccaaccucuucuucgccgucuaccaagacgacaacaaaggaaaacgaaauuaugagacaauccccuuaaacauagucauagaacgccaaaaacucggcuuacacagcgugccgaccgaagacgcuaaaggaggaaaacuccucuuccaccucucaccuaacgacaugguauacgugccaacaagcgaggaacucgaggacaaccuagcaagcgugaauaucaagcgacucaacacggcccaaagaaaacgcauauacaaagucgagaaggcaucaggggucgaaugcuacuucauccgccaggacaucgccuaucuaaucaaaaauuacgacgcgaagaccaagaucggagaacuugaaagccaaaacaaacuacagacaaccaugaccgacgacagacucaaaaucacggacgucugcgucaaauuaaacauagacaggcuaggcuccaucgcagaaaccuuccugggaaaccaauacggagccagcaaaaagaccuga

SEQ ID NO: 6874 - RNA, 4422 nt, Artificial Sequence
  Cas9 variant
auggcaaagauccuggggcuggaucugggcacgaacucgaucggcugggccgucguagaacgagaaaacauagacuucucacucauugacaaggggguacguauauuuucagaaggcguaaaaucggagaaagguaucgaaagcuccagagcggcugaaagaacuggcuaccgguccgcaagaaagauaaaauaccggcgcaaacugagaaaauacgagacgcugaaagugcugucccuuaaccgcaugugcccgcugagcaucgaggaagucgaagaauggaagaaaagcggcuucaaagacuacccccucaacccggaguuccucaaauggcuauccacagacgaagaauccaacgucaaccccuacuucuucagggaccgcgcaagcaaacacaaagugagccuguucgaacuaggccgcgcauucuaccacaucgcacaaagacgcggauuccucucgaacaggcuagaccagagcgcugaaggcauccucgaagaacacugcccgaaaaucgaagccaucgucgaagaccuaaucuccauagacgagaucagcacaaauaucaccgacuacuucuucgaaacaggaauccuagacuccaacgaaaagaacgguuacgccaaagaccuagacgaaggggacaaaaagcuagucagccucuacaaaucgcuucuugccauacucaagaaaaacgaauccgacuucgagaacugcaaaagcgagauaauagaacgccugaacaagaaagacguacuggggaaagucaaagguaagaucaaagacauaagccaggccaugcuagacggaaacuacaagacacuaggccaguacuucuacucacucuacagcaaagaaaagauacggaaccaauacaccucacgcgaggagcacuaucucagcgaauuuauaacaauaugcaaagugcagggaauagaccagauaaaugaggaggaaaagauaaacgagaagaaauucgacggccuagccaaagacuuauacaaagcaaucuucuuccaaaggccacuaaaaucccagaaaggccuaauaggcaaaugcagcuucgagaaaagcaagucgcgcugugccaucagccacccggacuucgaagaguaccgcauguggacguaccuaaacacgaucaaaauaggaacccaaagcgacaagaaacuacgauuccucacacaagacgagaaacucaaacuugucccgaaauucuaccgcaaaaacgacuucaacuucgacguccucgcaaaagaacucaucgaaaaagggagcucauucggcuucuacaagucgagcaagaaaaaugacuucuucuacugguucaacuacaaaccaacugacaccguagcggccugccaagucgcggccagucugaagaacgcuauaggcgaggacuggaagaccaagagcuucaaauaccagacgauaaacagcaacaaggagcaagucucgaggacaguagacuacaaggaccuguggcaucugcucaccgucgcaaccagcgacguguacuuguacgaauuugcaauagauaaauugggucucgacgaaaagaacgccaaagcguucagcaaaaccaaacucaagaaagauuuugcaagccuuucccucucggccauaaacaaaauccuaccguaccuuaaggaaggccuacuauauucccacgcuguauuuguggcuaacaucgagaacauagucgacgagaacauuuggaaagacgaaaaacagcgcgauuacaucaaaacccagauuagugagaucauugaaaacuacacccuugaaaagagcagauucgagaucaucaacggacuccucaaagaauacaaguccgaaaacgaagacgggaaacgagucuacuauucaaaagaagcagaacagaguuuugaaaacgaucucaaaaagaagcuaguacucuucuacaaauccaaugagauagaaaacaaggagcaacaagaaaccaucuucaacgaauuguuaccaaucuucauacagcaacucaaagacuacgaguuuaucaaaauacaacggcuggaccagaagguacuaauauuccucaaaggcaagaacgaaacaggacaaauauucugcacggaagaaaaaggcaccgcagaggagaaagagaagaagaucaaaaaccgccucaagaaacuauaccaccccucagauaucgaaaaguucaaaaagaaaauaaucaaagacgaguuuggcaacgagaaaaucguacuaggaagcccccucacccccucgauuaaaaaccccauggccaugcgugcacuacaccaacuacggaaaguccucaacgcacucauacuugaaggacagaucgacgagaaaacaauaauccauauugaaauggccagggagcucaaugacgcuaacaaacgaaagggcauccaagacuaucaaaacgacaacaagaaguucagggaagacgcaauuaaggagauaaagaaauuauacuucgaagacugcaagaaagaaguagaaccaacugaagacgacauccugagguaccagcucuggauggaacagaaccgcuccgaaaucuaugaggaggggaaaaacaucuccauaugugacaucaucggauccaacccugcguacgacaucgaacacacgauaccacgcucccgcucucaggacaacucgcaaaugaacaagacgcuuugcagccaaagauucaaccgggaagugaaaaagcagucaaugccaauagagcucaacaaccacuuagaaauccucccgaggaucgcacacuggaaggaagaagcggacaaccucacccgagagaucgaaaucauuagccgcagcaucaaagccgcggcaacgaaagaaaucaaagacaaaaagauaaggcgcagacacuaccucacacucaaacgagacuaccugcaaggcaaauacgaccgguucaucugggaggagccgaaagucggauucaagaacucacaaauacccgacaccgggaucauaaccaaauacgcacaagcauauuuaaaaagcuacuuuaagaaaguagagagcgugaaagggggcaugguugccgaguuccgcaaaaucuggggcauacaggagagcuucauugacgaaaacgggaugaagcauuacaaaguaaaggaucgaucgaagcacacacaccacaccaucgacgcaauaaccauagcaugcaugacuaaagaaaaguacgacguccuggcccacgcauggacacuugaagaccagcaaaacaagaaggaggcgcgcuccauaaucgaagccagcaaaccuuggaagacguucaaagaggaccuccuaaaaauugaggaggaaauucuugugagccacuacacacccgacaacguaaagaaacaagcaaagaaaaucguucgagugcgaggcaaaaagcaguucguugccgaagucgagagggauguuaacggcaaagcaguaccaaagaaagccgcuuccgguaaaacaaucuacaaacucgacggcgaaggaaagaaacugccccgccuccaacagggcgacaccauuagaggcucgcuccaccaagacagcaucuauggugcuaucaagaacccccucaacaccgacgaaauaaaauacgugauaagaaaggaccuugaauccauaaaaggguccgacguagaauccauaguugaugaagucgugaaggagaagaucaaagaagcgauugcgaacaaagugcucuuacucuccagcaacgcccagcagaaaaacaaacugguagggaccguauggaugaacgaggagaaacgaauagcaaucaacaaaguccgcauuuacgccaacagcguuaaaaacccgcuacacaucaaggagcauucacuccuaagcaagagcaagcacguccacaaacaaaagguguacggccaaaacgacgagaacuacgcuauggcgaucuacgaacucgauggcaaacgggacuucgaacuuaucaacaucuucaaucucgcgaagcuaauaaagcaagggcagggcuucuacccucuccacaaaaagaaggaaauaaaaggcaaaaucguauucguaccgaucgaaaagaggaacaagagagacgucguccuaaaaagaggacaacaagugguguucuacgacaaagaaguggagaauccaaaagacaucuccgagauagucgacuucaaagggcgcaucuacaucauagaaggccuuucgauccagcgcauaguccgcccauccggcaaaguagacgaauauggcgucauaaugcuccgauacuucaaggaagcccggaaagcggaugacaucaaacaggacaauuucaaacccgacggcgucuucaaacuaggggagaacaaacccacccguaagaugaaccacaaccaauuuacggcguuuguagaaggcaucgacuucaagguccuccccagcgggaaauucgagaaaaucuga

SEQ ID NO: 6875 - RNA, 4425 nt, Artificial Sequence
  Cas9 variant
augaagaagauacucggacucgaccucggaacaaacuccauuggcugggcucuaaucgaaucggacuucgaaaagaagcaggggaaaauaaacggccucggcucgcgcauuaucccaaugucccaggacauauuaggcaaguuugauuccggugucucgauuucgcaaacugccgaacgaaccagcuaucgaggaguaagaaggcugaaccaacggaaccuccuacgccgggaaagacuacaccgcguacugaauaucuuggacuuccuacccaaacacuacagcaacgcaaucgacuucgagaaaaagcuaggccaguucaaggagaacguagaagaaaaacugaacuacgccaaaaaucagauaggccggcacgaguucaucuucauggauucauucaaggaaauggugaaggaguucaagcaaacucagccccaacucuuuuacaagcgggaaaacggcauugagacaaaaauacccuaugacuggacccucuauuaccuuaggaagaaagcacucucacaaaagaucaagaaagaagaacuagccuggaucauucugaacuuuaaccagaaacgaggcuacuaccaacuccgcggcgaggacguccuagacgagagcaagaucgaggacuucuacucacucaaagucguggaaguccaagaaacggaagacaaaaacgcgcgggggaccugguauaacgugauccuugaaaacgacugggucuauaaacgacaguccaaagagagccuggacaacuggauaggcaaaaacaaagaguucaucgucaccaccaacaaagagaaagacggaucccuuaagcucgacaaagccgguaaugucaaacgcaacuuccgcgcugucgacuccgaaaaagacuggauagcgaucaagaagaaaacagagcaagacguggagaucucaaaacauaccguaggacaauacauauacgaaacccuacuacaaaacgccaaacagaaaaucaaggggaaacucguaaagaccauagaacggaaauucuacaaagaagaguucaucaaaaucauaaaggaacagcucaaacaccaucccgaacugcaaucuaaaacccucuacgaaaccuguauacaagaguuguacccacggaacgaagcccaccaaaauaacauuaagagcaaaggcuucgaauaccuuuucacggacgacauaaucuucuaccaacguccgcucaaaagcaagaaaagcaccauaagcggaugccaauacgagacccgacuauucaagaaaacaguacuaaacaagguaacaaacaaagaaaacgagaucuggcagaaggaaccacucaaggccauaagcaagagucacccgcuguuccaggaguuccgccucuggcaauuccugaaaaaccucaaaauauaucaaaaagaagacgucaaaggcaaccucaucgaccacgacauuacguccgaccuccucaagacagaagcagacugggucgaacuuuucgacuuucuaaauaucaagaaagagauagaacaaaaacagauaauacaguucuuuaucaacaacaaacaaauagaaaaaggcaagaaaaacaacuaccgcuggaacuacgucgaggacaagaaauaccccugcaacgagacaaaaucccaacuaauuagccgucuaaagaaagucaaaaaccuagaccucaaccuuuucuucacgagugaaacagaacucaaacuauggcacaucaucuacagcgucaaagacaaaauacaauacgagaaagccaucaaaaacuucgcaaucaaaaacaauauagacauagacagcuuuguagaaaacuucaaacguuucccuccuuucaaaaacgaauacgcggccuacagcgaaaaagccaucaaaaggcuccucccgcucaugcgcaugggcgaguacuggaacgaaagcgagaucaagcaagaggucaaggaccgugccuacuccauaauagaaagacuuaagggaauagacuucaacaaagacaagauagacgagaaaauaaccgacgacgacauuaagaagcaacuacucaagagcuucauagauuucaaagacaagaauccccuaaagggccucaacacguaccaagccugcuaucucgucuacaaccggcacuccgaaguaaacagcaucgcuuacuggaaaagcccagacgacauaaacaaauaucucgaaggcuucaaacaacacagucuccgcaacccgaucgucgaacaaguagugacagaaacccugcgaaccgucagagacauauggcaguacuacgguaaaggaaaagcgaguuucuuuaacgaaauccacgucgagcuaggccgggaaaugaagaacccagcguacaaacggaaagcaucuacgaaccgcgugacggaaaacgagaacacaaaccacaggauaaaggagauccucaaggaacugcaaaacgagggcguacaggaggucaagagcuacucacgcaaccaacaggagauccucaaaaucuacgaggaggguaucuaccaaagcauagacguaguugacgacgccauagagaaaauaaggaagaacuccagcccaaccaaagccgaaaucaucaaauacaagcucuggcucgaacagggguacacgucaccauacaccgggaaaacaaucccaaugagcaaacuauucaccaccgacuaccaaauugaacacauuaucccgcaaucccucuacuucgauaauucacugucgaacaaaaucauaugcgaaucagaggugaaccaacuuaaggauaaccagacugccuacgaguucauuaaaaagcacggcacggaaaaggugagucuaggcaaaaacaagacagucgaaaucuucacucucgaacaauaugaaaaacacugcaaccaauacuuuaagaaaaacaaaaacaaacucaagaaacuccucagugaagaaauaccugaaggauuuaucaauagacaacucaacgauucacgguacauaucgaaauucauaaaaggccuacuaggaaaccucguacgggaagaagacgaacaagaaguuacaacaaagcacaucgucccagucacaggagccaucacaagcaaacugaagcaggacuggggccucaacgacaaauggaacgaacucgucgccagucgcuuccagagacuaaacaccaugaccaacucuaacaacuucggauacugggacacgaaaaucaaugcguuccgaguccaaguaccugaugaaaucagcaagggauucagcaagaaaaggaucgaccaucgccaccacgcacucgacgcccucgugauugcgugcugcacccgcaaccacaucaauuaccucaacgcgcucaaugccgaaaagaaaaauuacggcuuacgcgaccuccuacucauaaagaacgacaaaaaccacuacacaaaauucuucaagcacccaugggacggauuccccguggaagcaaaauccguacuagagaaaacgauaaucagcuucaaacaaaacacgcgaguuauaaauaaaacaaauaauaaaacguggcagugggcugaaaaagaagggcagcuaaagaaggugcuagugaagcagacaaaaggagacaacugggccauacguaaaccuaugcacaaggaaacagucuccgggaagcucaacauacccacacccaaaggcaaaaucgcaaccgccucccgagucucucugagcgaaaucaaaacccgaaaacagcuagacaagauaaccgauaucuccauccaaaagauccuggaacgccaccuaaauaauuaccucgacgacaaaggcaaagagaaguuugaccuugcguucaacgcagacggggucgaagaacucaacaaaaacaucaagguccuaaacaagggcaaaaaccaucaaccgaucuacaagguucgucuauaugagaucggcucccgauucaaagucggcaacagcggaaauaaaaaggacaaguacgucgaagcggcgaagggcacaaaucuauucuucgccauauaccuaaaugagaaagacaaaaagcgcgucuacgaaaccaucccccugaacgaagucaucgaacaccaaaaacagguuaguaaccuaccgaagaaugagcgaaccccgguaccgguuaaccauacaaagggaaaauuccucuucagccucucaccaaaugaccucguauacguacccaccgacgaagaaauagacaaccccucccuagugaacuucaacaaccuuaacaagaagcaaguagagaaaaucuacaagaccgucucaugcuccaccuaccaaugcuucuuuguccacaacaccauaagcaaacccauacagaacaaagucgaguucuccgcacucaauaaaauggaaaaaucgauugacggcaucaugauaaaggacaggugcuggaaacuaaaaauggaccgccuugggaacauuauauccgucaucagguga

SEQ ID NO: 6876 - RNA, 4443 nt, Artificial Sequence
  Cas9 variant
augaaaacaauucugggccuggaccuagggaccaacucuauaggcugggccaaagugugcgucgacaacgauggaaacuaccuaagggacauaaaacucgggucgcgaauuaucccgaugagccaggacacccugggcaacuucgacaaaggagucacugacucaccaacagccgcacguacgggcuuucggggcguaaggcggauccgcgaacgcgcgcugcaacgccgcgagagacuccaccgcgugcuacacgucaugaaauuccugcccccgcacuaugagaacgccaucgguuggaacagagaggaagccacaaccuacggcaaauucuuaaaccacggggaacccaaauuagccugggagaaacaagaagauggcucgaugcgauuccuauucauggacucuuuucacgagaugauggcggacuucgccgaaucgcagccggggcuagucgcuggcggaaagaaaaucccccucgacuggacccucuacuaccugcgaaagaaagcccucacgcaagccauccguaaggaagaacucgcauggauacuccucaacuucaaccaaaagcgaggcuacuaccaacuccgcggggaggaggaugaggaaaacccagcaaaaagagaagaguaucacgaacuaaagguaguaagcgucgaagcagccgaagaaggaaagggagggaacacaugguacaauguaacccuagaaaacggguggauauaccgaaggcaaagcaagguggagcugcacgacuggguggggaaaacccgccaauucauuguaacgaccgaguacgagaaagacggaguaacgaucaaaaaggacaaaaacggggaagucaaaagaucauuccgggccccaucagaggacgacugggggcuucgcaagaagcgcaccgaaagccugcucgaagacagcggcaagacaguuggggcauucaucuaugaccacauacuaagcgagccuacggacaaaauacgcggcaauuucauccgcaccaucgaacgcaaauacuacaagaaagagcucgaggcgauauuacucgaacaaacaaaacaccauaaagaacuaaaggaccaaaacacccucaucgcgugcaucaaggaacuguaccaaagcaauaagccacaccaagauucacuaaugaagaaggacaugaccuaccuauugaucacagaccuuaucuucuaccaacgcccccucaagucgaaaaagucacucaucgccgacugccccuacgaauauuacgaauauaccaucaaagagacaggagaaauaaaaagacagggaaucaagugcauagcaaaaucaaaccccuacuaccaagaguucaggcuguggcaauucaucauaaaccugcgacucuucgauagaaccgaugacaaagaaguaacuagcgaauaccuaucgaguauggaagacuacaccaaacucuucaccuaccugaacgaccgaaaggacaucaaccaggaaacucuccuuaaggacuucuucaagcaaaagaaaguaaagaugggaauggaaaaagaguuccccauccgcuggaacuacaucgaagacaaggaaaagaaauauccgugcaacgaaacccgccacgaguugcucgccgcucuagauaaagccgggaucgaccacucguggcucgaugacaaagagcgauucuaccgauuauggcaccuacuauauucaguggagaguaaggaggaagccgaaggcgcccuccgcaagcucaaagacaacgacgacuuugugaacgccuuccucaaagugaaacccuucaagaaagacuauggcgcguacagcgagaaagcagucaagaaacuccuggcgauuaugcgcaugggcggacucuggaacgaaacggacauaugcgaacaaacaagaaacagaauccagucuaucauaaaaggagagaucgacgagaaaauaaaagaacggaugggcagaaccuucugccaauuaagugacuuccagggccuccccgaauggcuagccuguuauguuguuuacggccggcacagcgaagcgaccgacauccaacgcuggacaaagccggaaaaccucauggcauauauaaacggauucaaacaacacagccuccgaaacccuauaguagagcaaugcauccuggaaacgcuccgcaccgugcacgacauauggaaggaagccggccacauagacgagauccacguagagcucggaagaagcaugaagucaacugccgaccagagggcgagaaugagcaaaagcauccugcaaaaugaaaacacgaaccuucgcaucaagagccuucuaauggagcucaaaaacgcgaaagaaaucgagaacguaagaccauacagcccuaugcaacaagagauauuacguauauaugaggaaggcgcccugcaagaguuaaccaaagaagacgcacaguacccagagaucagcaaaaucucacaaauggcacaaccaucggccaaggaacuacucaaguaccgccuauggcuagaacaaaaguacugcaguccguacaccggaaagccaauaucgcugagcaaacucuucaccagcgcguaucagaucgaacacaucauaccgcagagccgcuacuucgacgacuccuucacaaacaagguaaucugcgagacggaagucaaccaacuuaaguccaauaugcuaggauacgaguucaucaaaaagcauucuggagaaauaguucacugcacgacaauaggcgacguaaaaauccucgacgcuaaagaguacuacaacuucgucacggaacacuacgcaaacaaccgccgcaaaaaggaaaaacuucuccuggaggacauaccccaggaguuccuaaaucgacagaugaacgacagucgcuacauuucgaaaaagguuauggccauccugagcaauauaguccgggaagaagacgaacaagagaccaacagcaaguucguagucagcugcuccggagggauaaccgaccggcuaaaacaagacuggggacugaaugaugucuggaacagcauuguuuacccgcgauucgaaagacuaaacaaguugacccaaaccgaggcauuuggaaggugggaaaauaaagagggaaaacaagucuuccaaaccucgcuuccacucgaacuccaacgaggguucagcaagaaacggauagaccaccgccaccacgccauggacgcgcuaguuaucgcaugcgcaagcagaaacauuaucaacuaccucaacaaugaaucagcgaaaucacaagaacaacgugaggaccuacgcaagaaacucugcgacaaaaacagaaucauccgcaaacccugggaaacguucacgcaagacgcgcggacugcacuagaagacgucguugucucauucaaaaacuacguccgcguaauaaacaaagcgaccaauuacuaugagaaguacgacgagagcgguaaaaagggaauggccgaacaaaagggacaggacaugugggccauccgcaagccgaugcacaaagaaacaguuuucgggcaaguaaaccuccgccgaaagguaacagucaagcugaaggacgcccuagaaaacaucccagcaaucugcgacaaagcacuccgggacuacguaaacgaccucaucgcaaagaaguucaacacgaaacaaaugcuagcacacuucaaaagcaucaacuaucgacugaacaugaaaagcguaaacaaagucgggauaugggucuucagcgacgaaaaagagccuauggucgcaaccaggaaagcaauugauauauccuucgacgcgaaacguaucgacacuaucaccgauaccggaauccaacagauacuaugcaaauaccuaaaaagcaaagggaacgacccgaacguggcauucaccccggagggaauagccgagaugaacaaacauaucauugacuacaacaacggcaaacaacaccaaccgauacuaaaaguacguguauccgaacccaagggagcgaaguaccaagugggagaaaccggcaauaaaaccaagaaauucguagaagcccagaaagggaccaaucucuacuucgccaucuacgaagacaaagacggcaaucggagcuacaacaccauaccauugaaugaaguggcagagagacugaaacaaggccugagccccgugccagagaagaacgaaaaaggcaucagccucaaauucuaccuaagcccaaacgaccucgucuacgugccaaccgaagaggagaaacucuccaacgaaugcaaacucuccaaggagcggaucuacaagaugguauccagcaccuccaacgagugucacuucauaccauacaccacggccaagcccaucuacgacaaguuugaauacgaagcgaagaacaagaugggacgcgcucuaacaggcgaaaugauaaaggcugugugcuggaagcuggaaguagacagacugggaaauauacucaagaucaucaaauga

SEQ ID NO: 6877 - RNA, 4452 nt, Artificial Sequence
  Cas9 variant
augaaaacgauauuaggauuagaccugggcaccaacagcaucgggugggccaagauaucaaucgacgacaaugguaacuaccuuagagauauccaaauggguagucggauuauacccaugucccaagacgugcugggcaacuucgacuccggcguuaccgagucccaaaccgcaguccgcaccggauuccgcggccuccgcagaaucagggaacgcucacuccuccgcagagagcgacuacaccggguacugcacgugaugggauuccuaccaccccacuacgacucugcuauuggcuggaacaaagaggaacccacaacguacggcaaauuuuuaaaccauggcgaaccaaagcuggccugggaacgacaaggagacggaucaaugcgcuuccuauuuauggacagcuuccacaaaaugauggaggacuucgcgccacaccaacccgcacucguggccgacggccggaaaauaccgcucgauuggacccuauacuaccuccgaaagaaagcacucacacaaccaaucaaaaaggaggaacuagcauggauccuacuaaacuucaaccagaaacgcgguuacuaccagcuacgaggagaagaggaggaagaaaacccgacaaaacgcgaagaauaccacgaacucaaaguagucagcguugaggccgcggaagaagggaaaggaggaaacacaugguacaaugucaaacuugagaacggauggaucuacagacgcuccagcaaaauaccccuggacgacugggugggaaaaacacggcccuucaucguaacgacagaauacgaagcagacgggauaacccugaaaaagaacaaagaaggagaagucaaacgauccuuccgggcccccggagaagacgacuggggacuacgaaagaaacggaccgagucacaacuagaggcuagcgggaaaaccgugggcgccuuuauuuacgaccacuuacuugcagaaccugcggauaaaauaagaggcaacuucauucgcaccauagagcgcaaauacuacaaacaggaacucgcagacauacugcgcgaacaauccaaauaccacgaggaacuccaauccaagaaaauacucgccgacugcgccgaggagcucuaccgcucgaaccagccgcaccgagacucgcuccugaagaaagacaugguguaccucuuacucacagacauuaucuucuaccagagaccccucaaaaguaagaaaucauuaauagccgacuguccauacgaguacuacgaguacgucgacaaggagaccggcgagaucaaacgucagggaaucaagugcgucgccaaauccaacccguacuaccaagaauuuagacuguggcaauuuguauuaaaccucagacuguacgacagaaccgaagacaaagaggugacagccgaauaccuuccaagcaaagaagauuacgcgcgguuguucguguaccuaaacgaccgcaaagaaauaaaccaagagacccugcuaaaagacuucuucaaacugaagaaggucaaacaacggagcgaaaaggaguucccaguccgguggaauuacaucgaagacaaggaaaagaaguaccccugcaacgaaacccgacacgaacuccuaauggcacuagaucgcgcaggcauagaacguagcuggcuagacgacaccgcccgacaaugcagacucuggcaccuuuuguacagcaucgaggucaaagacgaagcggaaagagcacuacggaaacucaaagacgacgaugaguucgucagcgccuuccucaagguaaaacccuucaagaaagacuacggcgccuacuccgaaaaagcaguaaagaaacuccucgcaguaaugagaaugggaucgcacuggugcgaagacgacauauguaaagagaccaaagagcgcaucgaacacauccuacaaggcgacgucgaggagaaaaucaaagaacgcaugaaccacaccgcguauagucugggcgaacugucugacuuccaagcccuaccggaauggcucgcaugcuacgucguguacgggcgccacucagaagcaacggacaucaaacacuggaaaaccccggagucgcucauggcguacauuaacgguuuuaaacagcacucccucagaaacccaaucgucgaacagugcauacucgagacacuccggaccguccaugacauauggaaagaggcaggccacaucgacgaaauccacguagaacuggggagaagcaugaaaagcacgucggaccaacgagcacggaugaccgaaaacauacuacgcaaugaaaacacaaaccuacgcauaaagucccuccuuauggaacuaaagaacgacgcagacaucaaggacguccgacccuacaguccgaugcaacaggagauacucagaaucuacgaagagggggcgcuccaagagcucaccaaagaagacaacgacuaugaagagauauuuaaaauaucgaagaugccccagcccucagccaaagagcugcuaaaauacaaacuguggcucgagcaaaaauaccguucgcccuacaccggaaaaccgauaucccucagcaagcuauucacgagcgcuuaccagauagagcacaucauaccacaaucucgguacuucgacgacucauucaauaacaagguaaucugcgaauccgaaguaaacgcccuuaaaggaaacaugcuaggcuacgaguucaucaaaaaccacggaggcgaaauaguucacugcacacuccucggugacguaaaagugcaaaaugaaucggaauacaaggcauuuguaacggaacacuacgcaaacaacaaauacaaaaaggaaaagcugcugauggaagacauaccacaagacuucuuaaaccgccaccucaaugacagcagguacaucucaaaagucguaaaaacgcuccucucuaacaucgugaggacagaagacgaaauggaaaccacaagcaaauucguaguaucgugcacggguggaaucaccgaccgucugaagaaagacuggggccucaacgacgucuggaacaguaucgucuacagccgcuucgagcgacucaacgagcuaaccaaaucugacgccuucgggcgaugggagaacaaagagggcaaaagagucuuccagacaucaguaccacuggaacuccagcguggcuucaacaagaagcgaauugaccacagacaccacgcgauggacgcgcucgucauugccugcgccagcaggaauaucaucaacuacuuaaacaacgaaagcgcaaauuccccaaagaaacgcgaagaccucagacaacaacuaugcgauaaaaaccguauaauccgaaaaccaugggaauccuuuacccaagacgcacgugccgcgcucgaagacguagucguguccuucaaaaauuacguacgcguuaucaacaaagcaacaaacuacuacgagcgcuacgaugccgacgggaagaaaaccaucacaaaacaaaagagccgcgaaaugugggccguacggaaacccaugcacaaagaaacagucuucggccacgucaaccuaaggcggaaagcgaucgucaagcucaaagacgcccuggaaaacauacccagcauuugcaauaaggagcucagggacuauaucaaugggcucguggaacgcaacuucaacaccaaacaacuacaugcccacuucagaagcaccgacuaccgauggaacaaacaaaacguagacaaaguagagguauggcgguuuucugacgaaaaagaaccacucgucgcaacccggaaaccgcuggacacauccuucgacgccaagcgaaucgacacgauaaccgacacaggcauacagaaaauucuccucaacuaucuagaggcaaaggguggggacccccuuauugccuucacgccagaaggaauagcagaaaugaaccaaaacaucgcucucuacaacgaugguaaaaugcaccagccgauucucaaggugcgaaucagcgaacccaaaggcgcaaaguaccaaauaggacaaaccggcaacaaagccgacaaauucguagaggcccagaaaggcacaaaccuguacuucgcgaucuaugaagacgaagaccgcaaccgcacauacaacaccauaccgcucaaugaggucgccgaacgccucaaacagggacuaccaccaguuccugagaaaaacgaaaaagaaguaccacuaaaauucuaccucucgccaaacgaccuagucuaugucccaacggaagaggaaauacuaaugaaagaaugcaaacucaacaagaaccggaucuacaagaugguauccucgacggggaaccaaugcuuuuucauuccguuccgggucgccgucuccauagucaacaaaauggaguacaguccccuaaacaaaauggaaaaggcaaucuccucggagaugauaaaagcagucuguuggaaacuagaaguggaccgacuagggaacaucauacgggucguaaaguga

SEQ ID NO: 6878 - RNA, 4452 nt, Artificial Sequence
  Cas9 variant
augaaaacgauacucggccuggauuuaggcaccaacagcauaggaugggcuaaggucucucuugacgacaacggaaacuaucuccacgacaucaaacuaggaugccgaauaaucccaaugagucaggacguacucgauaacuucggaaaaggcguaacgguuucccaaacgucuguccgaacaggcuuccgaggagugcggaggaucagagagcgcagccuucagcgccgggaaagacuacaccgcguccugcacagacucggcuuccuaccucagcacuaugacgcugcaauaggcugggacagcgacugcgccaaaacguacgggaaauucuuggacaauggcgagccgaaacuggcaugggaaagacaagaagauggaucaaugagauuccuguucaugaauagcuuuuacgagaugauagcggacuucacgucccaucagccagcccuaguagccgacggcaaaaagaucccccucgacuggacucucuauuaccuccgcaagaaggccuugacccaagcaauacggaaagaggaacuggcauggauauugcucagcuucaaccagaaaaggggauacuaccaacuaaggggagaagaggaagacgaaaaucccaccaagcgagaagaguucugcgagcuaaaaguggucgccguagaggcugcggagaagggaaaaggagacgacaucugguacaacguccacuuagaaaacgguugcaucuaccggcgauccucaaaaaucucguuagaugacuggguaggcaagacaaaacaauucauaaucaccacugaauacgagaaagacggagucacccccaagaaagacaaagacgggaaagagaaacgcaguuaccgagcccccaaagaggaugacugggggcuacgaaagaagcggaccgaaacugaucucgaggcuagcggcaaaacaguaggcgccuucauauacgagcaucuccucgcagaacccuucgacaaaauccgcggcaauuuuauacacaccauagagaggaaguacuaccgugcagaacuagaggcuauccucacugagcaacgcaaauaccacgaggaacuacggucggaacaaaugcuggccgucugcgccgaggagcuauaccgcagcaaccuaccgcaccagcaauccuugcuuaaaaaggacauggucuaccuacugcuuuccgaccuaaucuucuaccaacguccccuuaagucgaagaaaucacuaauagccgacugcccguaugaauacuaccgauacgucgacaaagagacaggagaaaucaagaaacaagguaucaaaugcaucgcuaaaagcaaucccuacuaccaggaauuucggcuauggcaauucguccucaaccuacgccuauucgacaggaugaccgacaaagaaguaacagcagacuaccuccccaccaaagaggacuacgugagacuauucgacuaccucaacaaccgcaaagaaauuaaccaggagacgcuacuaaaagacuucuuccgacugaagaaagucaaacucggacgcgaaaaagaguucgaaauccgauggaacuacauugaagacaaggagaaaaaguacccgugcaacgaaacgcgauacgaacuccucguagcccuagaccgggccgguaucgaccgaucguggauagaugaagacggucgacaguaccgucuauggcauuugcucuacuccauugaaguaaaggccgaagcagaaucagcacucagaaaacuaaauagcgacgacgcguucgucucauccuuucuaaagguuaaaccauucaagaaagacuacggggcauacagcgaaaaagcagucaaaaagcuccucgcgguaaugcgcaugggaucaauguggucggaagcaaacaucugcgaagaaacgcaaaacagaauccgauccauaaucagaggagacaucgaggagaaaauaaaagagcgaaugggacacaccgcacgcagcuucaaccaaaucgacgacuuccaagcgcuccccgaauggcucgcaugcuacguagucuacggacgacacuccgaagucacagauauacaacauugggaaacaccugagcaacuacaauccuacaucaauggauucaaacagcacagccugcgaaacccaauagucgaacaaugcauccucgagacccucaggaccguccacgacauuuggaaagaagcaggccacaucgacgaaauacacguugagcuaggcagagacaugaaacgaaccgccgaccaacgcgcgcgcaugaccaaaaacauacucaaaaacgaaaacacaaaccuccguauaaagucgcuccugauggaacuaaagaaagacaccgacaucaaagagguucgacccuacucacccaugcagcaggagauacuacgcaucuacgaagagggcgcacucuugcaacuaaaaagagacgacgaggcuuucgccgacauaagcaaaaucucccaaauggcccaacccacagccaccgaacugcgucgcuacaagcucuggcucgaccaaaaauacaggagcccuuacacaggaaaauucauuucacucuccaagcuauucaccuccgcguaccaaaucgaacacgucaucccacaaagccgcuacuucgacgacagcuucuccaacaaggugaucugcgaggcagaagucaaccgccuaaaaucaaacaugcucgguuacgaguucauaaaggcccacggaggagaaauaguacacugcacuaugcucggugacguaaagauccugucggaaagcgaauauaaggccuucgucaacgaacacuacgugaaccaccgcgcaaagaaagaaaaacugcuaauggaggauauaccgcaagaguuccuaaaccgccaaaugaacgacagccgauacaucagcaaaguagucaaggcgcuucugaguaacaucguccggacagaagacgaaauggacgucaccaguaaguuugucguaccaugcuccggaggaauaaccgaccgauuaaagaaagacuggggccuaaacgacgucuggaacuccaucguguacccaagguucgaacgacuaaaucgcaugaccggaacggaagccuucggacacugggaaaauaaagagggcaaacgcguauuccaaaccucagugcccauagagcuccaacuaggcuucucgaagaaacgaaucgaccacagacaucacgccauggacgcccuagucaucgcaugugccuccagaaacaucaucaacuaccuuaacaacgagagcgccaacagccagaagaaacgcgaggaccuaagacgccugcugugcgacaaaaaccgcauaauaagaaagcccugggagagcuucacacaggaugcccgcgucgcccugcaagacaucguaguguccuucaaaaacuacgugcggaucaucaacaaagcaacaaacuacuacgagcgcuacgacgaacagggcaagaaaacgacggcagagcaaaaguccucagaaaugugggcuauaaggaaaccgaugcacaaggagacagucuucggacauguaaaccuaaagcggaaaacaaccgucaaacucaaaaaugcaauagaaaauaucccgaacauuuguaacaaagaacugaaggcuuacauaaacgaacucgucgagaaacacuuuaacaccaaacagaugcuagcccacuucaagucaaucaacuaccgauggaacagacaaaacguggagaaaguggaggucuggcaguacuccgacgaaaaggagcgaauggccgccacgcguaaaccgcucgacaccagcuucgacaagaaaagaaucgaaacaaucacggauacgggaauccagaaaauccuccugaacuaccuggaagagaaagguggcgacccaaacaucgccuucacgccggaaggaauagcagaaaugaacaaaaacaucucacucuucaacgacggcaaacuacaccaaccgauacucaaagucagagucgccaaaacgaugggcgccaaguaccaaguuggccaaacagggaacaaggccgccaaguacguaggagcucaggaaggaacaaaccuguauuucgcuauauacgagaacgaagagggggaacgcagcuacaaugcggugccacucaacgagguagcggaaagacucaaacaagggauguccccuguaccagagaaaaacgaaaaagacgucccguugaaguuuuaccucagccccaacgaccuaguguacgugccaaccgaagaagacaaacucagcaacgaaugcaaguuagacaacgagcgaauauacaaaauggucuccgccaccgggaagaagugccacuuccuaccauacagcgucgcaaacauaauauacaacaaaguagaguucgaaaguaugaacaagaugggaaaggcccugagcggggaaaugauuaaagccgucugcuggaaacuggaaguagaucgccuaggaaccauucugcgcgugaucaaguga

SEQ ID NO: 6879 - RNA, 4452 nt, Artificial Sequence
  Cas9 variant
augaaaaccgagcucgaccucaacaaagaccgccuauacaaacacguccugggccucgaccuaggagucaccucaaucggauucgcacacguagucgaauccgagaaccgcaacgagagcgagauaaaacagauaggcgugagagugauccaacucgauaacuucgacaaagucgacaaaagcggaaagaccuccgaguccaaaaaccccgcaguggacuuugcggccggcaaaggacuaacccccaacggaucaagaacgaagaaaagaggggcgcggcggaaucuggacagauaccaagaccggcgagacaaccuguuggagguacuaaccaagucgggguuuaucaauuccgagacaaagcgcaccgaagacgggaaacacacaacgcaccagaccugggaaauacgagccaaggccguaucagagaaaguagagaaagaggaauuugcccgcauacuccuagccauaaacaagaaaagaggcuacaaaucaagccggaaggcuaagaaugaagacgagggccaggccguggacgggauggcgguagccaagcgcuuauacgaggagaaucucaccccagggcaauaugcguacgagguucuguccgggggcaagaaaagcaucccggauuucuaccgaucggacuugcaagcggaguucgacaaaaucuggaauuuccaaaaacaauucuacccaaacauccuaacagacgaguucuacgaagaacugaaaggaaaggggcaaagggcgaccucggcagccuucuggaagauccaccaauuuaacacagccgauauaaaagaccuagaggacgaacucaaaaacgagcgcacaaucaaacuguccaaacgcgaucagaaaaaguugcaagccuauaaauggcgcuccgaagcgguggucaaacaacuaggcaaggaagaggucgccuacguauugaccgagauaaacaacaaucucaacaauucaucaggauaccuaggcgccaucucggaccgcagcaaggagcucuauuucaauaagcaaacgguaggccaguuccuguacaagcaacucaaggaaaacccacacaccagacuuaagaaccaaguauucuaccggcaagacuaccuugaugaguucgaaacgaucugggaaaugcaagcccaguuccaccccgaacucacgcaggagcucaaagaagagauuagagacaucauaaucuuuuaccaacggaagcucaaaucucaaaaaggccuuaucagcuuuugcgaacucgaaucaaaagaaguugugaucaacgacacaaagaaaauaauaggccuccgcguagcccccaaaagcucgccacuauuucaagaguucaaaauuuggcagaaccucaacaacguucucguccguaaaaagggaucaaggaagcgcaugguaaaagcccaaaaccagcacagccucuucgaggaaccgaaagaaauauuuagucucgaccucgccagcaaggaaaaacucuucgaggaacugaaccuaaaaggaaaucuaucggcuaaaaacugccuagacauacucggccuaaacuccaacgaaugggaacugaacuacacccaacuggaggggaaucggacuaacaaaucacucuaugaggcauuccugaaaauacuagacaucgaaggauacgacguaaaagacuugcuuaagguaaaaaguagcaaagacgaagucgagcuggacgaccucaagguaccggcaagcgaaaucaaaaacaugguaagagaaauauucagcaccaacaagaucgauacagaaauucuugacuucgacgccgaaaucgauggaaaggccuucgagaaacaaagcagcuaccagcuauggcaccuacucuacaguuacgaaggcgacgacucacagucaggaaacgagaagcuguacgaauugcucgcgaagaaauucggcuucaaacgggaacacgcccaaauucuggcaaaugugagccuggucgacgacuacggcaaccucaguucaaaggcaaugcggaagauuuauccgcacauccgcgaaaauaacuacuccaccgccugcgagcucguaggauaccgccacagcaaacacagccuaaccaaagacgaacucaaagaccguguucucgaagaccgucucgaacugcuaaagaaaaacucccuccgacaaccagucguugagaaaauacuaaaccaaaugaucaacgcgguaaacgcucugaucgagaaaaacuccgaacgagacgaaaacggaaacauaaccaaguacuucaaguucgaugaaauaagaaucgaacuagccagagagcucaaaaagaacgccgcagaacgagcagaaaugacgacaaauaucaacgcagccaagcuaguccacgagaaaauauucaaaauccuccaaaacgaguuugggaucaaaaaucccacacgaaacgacaucauccgauaucgccucuacgaagaacucaaaggcaacggcuauaaagaccucuacucaaacacauacaucccccgggaaauccucuucagcaaccaaauagacauagaccacauccucccgcagucucggcuguuugacgacucauucucgaacaaagucguugucuuucggaaagacaaccucaagaaagggaaccaaacggcgauagacuauauaggauccgaagucggcgaggagggccugaaaaacuuuaucgaacgcguggaaagccuauacgagcuuggcaaaaagaauaaagaagaaggaauaucgaaagcgaaguaccagaaacucuuaaagagcgcaucggaaaucggagauggauucauagaacgggaccuccgcgagucccaauacauagcuaagaaagcaaaagaauuacuauucaagguuaccagauccgucguauccaccuccgggagcaucacggacagacucagagaggacuggggacugaucaacgucaugaaagaacucaaccugccaaaguacaaaucacuaggacuuacagaaauccaagaaagacgcaacggacaccaggucgaagucaucaaagacuggaccaagcggaacgaucacagacaccacgccauggacgcacuggcuguggcauucacgaagcacaaccauauacaguaccuaaacuaucuaaacgcacggaagaacgagucgcacaagcugcacggcaacauaaucgcgauugagacgcuggaaacagaaguaaaaaucgacgaccuuggcaauaagaaacgaguguucaaagaacccauaccgaacuuccgccaggucgccaaagaacaccucgagaauguacucauaucacacaaagccaaaaacaaagucguuaccaaaaacaagaacaaaaucuccggcaaagagaaacuucaaauaacacugacaccccgagggcagcuccauaaggagaccguauacgggaaauacagguucuaccaguccaaagacgaaaaagugagcgcaaaauuugaccuugaaaccaucgaaaaagucgcuaacccgucguacaaggcggcccugcuacagcgccuaaacgaaaacgaaaacgacccgaagaaagcauucucuggaaagaacgcacucagcaagaaucccauauauaucagcauggaaaacgacauaaaggucccagacaccgucaagcucguauggcucgaagaagacuauucgauaaggaaagauguaacacccgagaacuucaaagacgaaaaaucaauugagaagauccuggacgaagggguuaaacgaauauuaaagaaccgacuaaaagaguucggcggcgacgcgaaagaagccuucuccgacuuagacaagaaucccauauggcuaaacgaagaaaagggcaccuccauaaaaaggguucgcauauccggcgucaaaaacgccgagccacuucacuacaagaaggaccacuuugggaacgauauacuggacggcaauggcaacaaaauccccgcggacuucgucucgacaggaaauaaccaccaugucgcaauuuacaaggaacccgaguucgacaagaaaggacagccgguccucgacgaacuagggaaucagaaauacaaccuucaggaaaaagugguuagcuucuucgaagccguggaacgaguaaaucaggggcugccaaucauagacaaaacguacaaucagcaccucggcuggcaguuuuucuucaccaugaaacaaaacgaaauguucgucuuuccaaacgaaaagacgagauucaacccgaucgagaucgacuuacuagauccgaauaacaagaaacugaucucgcuaaaccucuuucgaguccaaaagauagccaacaaaaacuacauguuucgccaucacuuggagacgaacgucgacgacaagaaagaaaugaaaaacaucgcauuuauacacauacagagcugcaaccuccugaaagaaaucauaaaaguccgccugaaccaccucggagacauagucagcgucggagaguacuga

SEQ ID NO: 6880 - RNA, 4452 nt, Artificial Sequence
  Cas9 variant
augaaaacgauacugggucuagaccuuggcaccaacagcaucggcugggccaaagucucagucgacgaccacggcaacuaccuccaugacaucaaacuaggaagcagaaucauaccaaugucccaagacauccuuggcaacuucgacaagggggucacugaaagccaaaccgcuauccgcacaggcuuccguucaguaagaagaaucagggaacgaagucuccuacgcagagaacggcuccaccgcgugcugcacgucaugggcuuccuacccccgcacuacgacagcgcgaucggguggaaucgcgaggaagcgagcacguacgggaaguuccugaaccacggagagccaaaauuagccugggagcgccucgaagacggaagcaugcgguuccuguucauggacuccuuccacgagaugauggccaacuucgcccgccaccaacccgcccucguugccgacggaagaaagauaccccuugacuggacgcuguacuaccuccgcaagaaagcgcucucacaagcaguagggaaagaagaacuagccuggauauugcucaacuucaaccagaaaagagguuacugucaacucagaggggaagaagaagaggagaccccaaccaaacgggaagaauauuacgaacucaaggugguaagcgucgaagccgcagaagagggaaaaggaggcaacaccugguaucgaguccaacucgaaaacggcuggauauaccgacggcccagcaaaauagcccuggacgacugggucggaaaaacaaaacaguucauuguaaccaccgaguacgagaaggacggcacgacccucaagaaagauaaagacggggaggugaaaagguccuuccgcgccccaggagagaacgacugggggcuccgcaagaaacgcacagaaucccaacuggaagcuagcgggaaaacaguaggcgcguucauauacgaccaccuacuggcggaaccggccgacaaaauacggggcaauuuuauacgaacaauagagcgcaaauacuauaagcaggagcuggaggcaauccuccgggaacaaaccaaacaccacgaggaacuacguucaaaagaaaugcuugcaaaaugcgcagaggaacuguaccaguccaaucaaccccaccgaaaaucacuccucaacaaagacaugacguaccuccuacuaacagaccucaucuuuuaucaacgaccacugaaaucaaagaaaagccucauagcggagugcccauacgaauacuacaaauacaaggacaaggaaaaggggaaaaagaaacggcagggaaucaaaugcgucgcgaaaucaaacccauacuaccaagaguuucgccucuggcaauucaucguaaaucuccgguuguucgaccgcaccgacgacaaggaagucacagccgaguaccugcgcagccgggaagacuaugcgagacucuucgcguaucuaaacgaccgcaaagaaaucaaccaagaaacgcuccucaaagacuucuucggccucaagaaaguaaaaauaggagccgaaaaagaauuugcaauccgguggaacuacauagaagacaaagagaagaaauacccauguaacgaaaccagacacgaacuacuacucgcgcucgaccgagccgggauggaccgaucuuggcucgacgauagugaacuccaguacagacuauggcaucugcucuacuccgucgaagcacgggacgaagcagaaggagcacugcgcaaacuacgggaugacgacgaguucgucggagcauuccuaaaaguaaaaccguucaaaaaggauuacggcgcauacuccgaaaaagccgugaagaagcugcucgcgguaaugcgaaugggauccugguggcacgaagaagacauaugcaaacagacucgugaccgcauugaaaggaucguacagggggacauagaagagaaaauccgcgaaagaaugggacacgcggcguacucguucaguagacuggcggacuuccaagggcuaccggaaugguuggcgugcuacgucguguacggacgccacucggaagcgacgcacauucuaagaugggacagccccgacaagcuacugagcuacauaaaaggauuccgacagcacucccuacgaaaccccauagucgaacaaugcauccuagagacacuacggacaguacacgacauauggaaagaagccgggcacaucgacgaaauccacgucgagcuggggagaagcaugaagucgaccgcugaacaacgcgcucacaugacgaaaaacauacuccgcaaugaaaauaccaaccuacgaaucaaaugcuuacuuauggagcucaagaacgacgccgacguaaaggauguccggccauacagcccgaugcagcaggaaauacuacgcaucuacgaagagggcgcgcuacaacaacuaacuaaagacgacgcagaauaugccgaaauaucgaagauaucgaagauggcgcaaccaagugcaaaggaacuacuaagguauaaacuguggcuagaacagaaguaccgaagcccauauaccgggaaacccauaucccuaucaaaacuauucacguccgcauaucagauagaacaugugauaccacaaucccgauacuucgacgacagcuucaacaacaagguaauuugcgaguccgaagucaauacccuaaaaagcaacaugcucggcuaugaauuuaucaaaaaccauugcggugagauaguucacugcaccaugcuaggagacguaaaggucuucagcgaguccgaauacaaagcauuuguaacugaacacuacagcaacaauaaguauaagaaggaaaaacuccugcuggaggacauaccacaagaguuucuaaaccgccaaaugaacgacagucgguacaucagcaagguagugaaaggauuauugagcaacgucgucagaacagaggacgagcucgaagcgacaagcaaauucgucguaucgugcacgggcggaaucacagacagacucaagaaagacuggggccuaaacgaugucuggaacagcauagucuacucacgcuucgaacggcucaacggccuaaccaaauccgaacacuucggccacugggagaacaaagaggggaaaaggguauuccaaacaucgguccccauggaacuccaacgcggauucaacaagaaacgcaucgaccaccgacaccacgcaauggaugcccuagucaucgcaugcgcaucacgcaacaucaucaacuacuuaaauaacgaguucgcaaaaucccccaaacaaagggaggaccucagacaacuacucugcgauaaaaacaggauuauacgcaaacccugggagaccuucacccaggacgcgcgagcggcacuggaagacguggucgugagcuucaaaaacuauguaagaguaauaaacaaaaccacaaacuacuacgaaagauacgacgcagacggaaagaaaaccauggucccacaaaaaggcaacgaaaugugggcagucaggaaaccaaugcacgaggggacaauguacggaagagugaaccugcggcgcaaagcagucgucaaacuaaaagaagcacuggaaaacaucaguaguauaugcaauaaagaacuuagggauuacauaaacguccugguagaaaaacaguucaacaccaagcaacugcuggcccacuuuaagagcauggacuacagauggaacaaacagcacaucgacaaaguugaagucuggcgcuucagcgacgagaagguccaaaugguagcggcccgcaaaccgcuggacacgagcuucgacaaagaaugcauugccagcauuacagacacaggcauacagaaaauccuacugaacuaccucgaaucuaaaggaggagaucccgccauagcauuuacauccgaggggauugcagagaugaaccaaaacauagccgucuacaacgacggaaagaaacaccagccgguaaucaaaguccgcaagucgacaaaacucggaaagaaauucgccguagggcaaaucggaugcaaaaguaaacaauuugugguagcagaggcaggcaccaaccuguacuucgcgauauacgaagacgaagaggggaaacgguccuacgauaccaucccacucaacgaaguaacugagcgccugaagcaaggccucuccccaguaccggaaaagaacgaaaaggagguaccgcuaaaauucuaccucucgccaaacgaccugguauacguccccaccgaagacgagaugcagaugaaggaaugcaaacuaaacaaagagcgaaucuacaaaaugguuucaagcaccgguaacgagugucacuuccuaccauacuccguagccuccgucaucuacaacaagguagaguucgaaaguaugaacaaaaugggccgcgcccuaaccggggagaugauaaaggccguaugcuggaaacuagacgucgauagacucggcaacauccugcgagugauaaaguga

SEQ ID NO: 6881 - RNA, 4452 nt, Artificial Sequence
  Cas9 variant
augaagacaauccuagggcuggaccugggcacaaacuccaucggaugggcaaaaaucagcauagacgauaauggcaacuaccuacgagauauucaacugggcagcaggauaauccccaugucccaagacgucuuaggaaacuucgauaacggagucaccgaaagccagacugcgguccgcaccggauuucgcggcuugagaagaauacgggaacggagucuccuacggcgcgagagacuccacagggugcuccacguuaugggcuuccucccgccacacuacgacagcgcaaucggcuggaacaaggaggagccaacuacauacggcaaauuccuaaaccacggagaaccaaagcuggcgugggaacgccaaggugacgggucaaugcgcuuccuuuucauggacucguuccacaaaaugauggaagacuucgccccacaccaacccgcacugguggcagacgggcgcaagauuccccuggacuggacccuguacuaccugcgcaaaaaggcacuaacccaacccaucaaaaaggaggaacucgcauggauacuacugaacuucaaccaaaaacgcggcuacuaccagcuccggggcgaggaagaagaggagaaccccacaaaaagggaagaauaccacgaacucaaagugguagguguugaagcggccgaagaaggcaaagggggcaacacgugguacaacguaaaacuagaaaacggauggauauaucgccgauccucgaaaaucccacuggacgacuggguggguaaaacuagaccguucauaguaacaacagaauacgaggccgacggcaucacccuaaagaaaaacaaggagggugaaguaaaaaggagcuucagagcgccaggcgaagaugacugggguuuguggaagaaacguacagaaucccaacuagaagccagcggcaaaaccguuggggccuuuaucuacgaucaccuccuagccgagccagcagacaaaauccgaggaaacuucauaagaacaauagagcgaaaauacuacaaacaggagcuagcagauauccugcgcgagcaauccaaauaucacgaagaacugcaaaguaaaaagauccuggcugauugcgccgaagaauuguaccgaucgaaccagccucaccgcgacucccuccugaaaaaggacaugguauaccucuugcucacagaccuaauauucuaccaacgaccacuaaagucaaagaaaucacuaauagccgauugcccauacgaauacuacgaguaugucgacaaagagacaggagaaauuaaacgacaaggcauaaaaugcaucgccaaaucaaaccccuacuaccaagaguucagacucuggcaauucguucucaaccuuaggcucuacgaccgcaccgaagauaaagaggucaccgcagaguaccuccccagcaaagaagacuacgcaaggcuuuucgucuaccucaacgacagaaaagaaaucaaccaagaaacucugcucaaagacuucuuuaaacucaagaaagugaaacaaaggagcgaaaaggacuuuccaguacgcuggaauuacauagaagauaaggaaaagaaguaccccugcaacgaaacgagacaugaacuccucauggcccuagacagagccggcaucgaaagaucuuggcucgacgacacugcccgccaguacagacuuuggcaccuacucuacucaauagaagucaaagacgaagcagaaagagccuuacgcaaacugaaggacgacgacgaguucgucagugccuuucugaaagugaagcccuucaagaaagacuacggggcauacagcgaaaaagcagucaagaaacuucuugccguaaugaggaugggaagccacuggugcgaagacgacaucugcaaggaaaccaaagagagaaucgaacacauccuacagggggacguaggcgagaaaaucaaggaaagaaugaaccacacagcguacucacugggggaacucagcgacuuccaagcauuacccgaauggcuagcuugcuacguugucuacggccgacacuccgaagcgacagacauuaaacacuggaagaccccggaaucccugauggccuacauuaacggcuucaagcaacacucccuccgaaauccaauaguggagcaaugcauccucgaaacacugcgcacaguacacgacauauggaaggaggcaggucacauagaugaaauacaugucgaacucgggaggucaaugaaaucuaccucagaccaacgggcacgaaugaccgaaaacauccuacgaaacgagaauacaaaccuacgcaucaaaagucuacuuauggaacucaaaaacgacgcagauauaaaagacguacggccuuacuccccaaugcagcaagagauacugcgaauuuacgaagaaggcgcauuacaagagcuaaccaaagaagacaacgacuacgaagagaucuucaaaauaagcaaaaugccgcaaccguccgcaaaagaacuacuuaaauacaagcugugguuagagcagaaguaccgauccccauacacaggcaagcccauaucccucagcaaacucuucacaagugccuaccagaucgaacacauaauaccccaaagucgauauuucgacgauuccuucaacaacaagguaauaugcgagagcgaaguaaacgcccugaagggaaacaugcugggauaugaguucaucaaaaaccacgggggcgaaauagugcauugcacccuccucggagacgucaagguccaaaaugaaagcgaauacaaagcguucguaaccgaacacuacgcaaacaacaaauacaaaaaggaaaaacuacuaauggaggauauaccccaggauuuccucaaccgacaucucaacgacucccguuacauauccaaagugguaaaaacacuucuaucgaacauaguaagaacagaggacgaaauggagacaacgucaaaguucgugguaagcugcacaggaggaauuaccgacagacuaaagaaagauuggggacuaaacgacgucuggaacucgaucgucuacucacgcuucgagcgccucaacgaacugacgaaaucagacgcauuuggcagaugggagaacaaagagggaaagagggucuuccagacgucaguaccccuagaacuacagagaggcuucaacaagaaacggauagaccacagacaccacgccauggacgcgcuugucaucgccugcgccagccggaacaucaucaacuaucuaaacaacgagagcgcgaacagcccaaagaaacgggaagaucuaagacagcaacuaugcgacaaaaaccggaucauccgcaaacccugggagaguuucacgcaagacgcccgcgcagcacuagaggacguagucgugagcuucaaaaacuacguccgcguaaucaacaaagcuaccaacuacuacgagcgcuacgacgcagacgggaagaaaaccauaacuaaacagaaaaguagggaaaugugggccguccgaaaaccuaugcacaaagaaaccgucuucggacacgucaaccuccgccgaaaagccaucguaaaacucaaagacgccuuagaaaacauaccgucaauuugcaauaaagaacuccgcgacuacaucaacggccucgucgaacguaacuucaacacgaaacaacuacacgcacacuuccgguccacagacuaccgauggaacaagcaaaacguagauaaggucgagguauggcgcuucucugacgagaaagaaccacugguggcgacacggaagccacucgacacauccuucgacgccaaacgaauagacaccauaacggacacuggcauucagaaaauccuccuuaacuaccuggaggcgaaaggaggggacccauugauagcuuucacgcccgaaggcaucgcugaaaugaaccaaaacaucgcacucuacaacgacggcaagaugcaccaaccaauccuaaaaguccgaauaagcgagcccaagggcgccaaauaccaaauuggccaaacgggcaacaaagccgacaaguucguagaagcacaaaaaggaacuaaccuguacuucgcaauuuacgaggacgaagaccgcaacagaacguauaacaccaucccacuaaacgagguggcagaacgacucaaacaaggacuuccacccgucccugagaaaaacgaaaaggaagucccgcucaaguuuuaccuuagccccaacgaccugguauacguaccaaccgaagaggaaauccuaaugaaagagugcaaacugaacaaaaaccggauauacaaaaugguguccagcacgggcaaccagugcuucuucauaccguuccggguagccgugucgaucgucaacaaaauggaauacucaccccuaaacaaaauggagaaagccauaaguagcgaaaugaucaaggcagugugcuggaaacucgaaguagacaggcuaggaaauaucauacgugucgugaaguga

SEQ ID NO: 6882 - RNA, 4458 nt, Artificial Sequence
  Cas9 variant
augaagaacauacucggacucgaccuuggaaccaacagcaucggcugggcaaaaaucagcauagacgauaacggaaaauacaucaaagauagcauaaaacucggcucccgaauaaucccuaugucacaagacguccucucaaacuuuuccaaaggagucacccucagccaaaccucagaacggaccucguuccgaggcgcacgaagacuccgcgaacgcaccuuacuacgcagagaacgccuccaccguauccuccaccuacuaggcuuccuccccaaacacuacgagaaagcgauagguugggaccggaacgauaacaaaaccuacggcaaguucaucaaccacgccgaaccaaaacuugcguggugcaaagacaauaacggaaaaaugcgcuuccucuucauggacucauuccacgacaugcuauccgaauuuagcgagaagcacccagaacuacuggccaacggaaagaaaaucccgcucgacuggacgaucuacuaccuacgcaaaaaggcacuguacaaggcaauuacuaaagaagaacuugcuuggauccugcuaaauuucaaccagaagcgcggcuacuaccagcuccgcggcgaagaagaccgagacagcgaggccaacaagaaagaguaccuggagcucaaagucaucgggguagaagccaccggggagaagaaaggaaaugauaucugguacaacauccaccucgaaaacggguggaucuacaggcgcuccagcaaaaacccccucaacgacuggcugggaaaagucaaaucauucauaguaaccacugaucucgaugccgacggaaacccaaagaaagacaaagacggaaauauuaaaagguccuuccgcgccccguccgagggcgauuggacucuuaucaaaaagcggacagagucacuauuagagaacucgggacagacagucgggcaauucaucuacaaccacauccucgaagaaccaagcgcaaaaauacgaggcaauuucauccguacaauagagcgaaaguacuacaaagacgagcucaaagccauccucgagaaacagaaagaguuccaccacgaacucucgucggaaagccuacucacggagugcgcaaaagaacuauacaaacgcaauauugcacaccaagaaguacugcuuaagaaaggcaugauccaccuacugcugaaugacauucuauucuaccaacgcccacuaaaaaucaagaaaucgcuaauugacaacuguccauacgaaaacuacaaauacguggacaagaaaagcggagacauaaaagucaaaaguauaaaaugcaucgccaaauccaauccauuuuuccaggaguuuaggcuuuggcaguucgucuccaaucuccgacucuaccgcaagagcgacgacaaggacgugaccuccgagcaccucgucaccacagaugauuacgccaaccuauucacauaccugaauaaccgaaaggacauaaagcaauccgugcuucugaaggaauacuucaaaauaaagaaagucaagacaauaaacggagccgaauacccggugcgguggaacuacauagacgacgauaacaaaaccuaccccugcaacgaaacacgcuaugacauccuccacgcacuuucuaagaccgagcuaaagagcgaauggcugacgcccgagagaaccuacaggcuuuggcaccuccuauacucgauagaaagcaaagaggaaaccaagaaggcuuugaacaaacucaacuugucagacgacuuuacggaagcguuucuuacuaucaagccauucaagaaagaguacggcagcuacucggagaaagcgauaaagaaacuucuaagccucaugcggaugggauaccuauggagcgaggacgaggcaauaaaacaagucggcgcggaaauagaaaagacaaucgaaggagaacugccagauuacguccugcaaagacucgagaaaagccaacacaacuacaauaaaauaucugacuucuccggacugccacuauggcuagcaucauacaucaucuacggccgccacuccgaggcuaaagagauaauacacugggacaaccccgagagcaugauggcauacauuaaggacuuccgccaacacagcaugcguaaccccauugucgaacaaugcguacuagaaacccugcggaccguacacgacauauggaaggagauuggucauauagacgagauucauaucgagcuggggcgcgaaaugaaaagcacaagugagcaacgaaaggcaaucacucagaacguacuacacaaccagaacacuaacauacgcaucaaacuccucuuacaagagcuaaagaacgacaacaacauaacagguguccgccccuacuccccaaugcaacaggagauauuacgcauauacgaggaaggcgcccuccaaggacucacaaaagaagacaaagacuacaacgacauccugaaaaucagccaaacggcccaaccgaccucuaacgaacucacgagauacaaacucuggcucgaacaaaaauaccgcucucccuacaccgggaaagccaucagcuuaucgaaauuauucacaagcgccuaccagaucgaacauguaaucccgcaaucccguuacuucgacgacucacuguccaacaaaguaauuugcgaguccgaaguuaacacccucaagaaagcaaugcucgggauggaguucaucaaaacaugcggcgggcagaaaguacacuguacccuccuaggcgacgucgaaauuuacaacgaggaagacuacaaagcauucgucaacgagcacuacuccaacaacagaaccaaaagaaacaaacugcucauggaagacaucccccaagaguucauaaaccgacaacuuaacgacagccgcuacaucagcaaaauggucaaacaacuacugucugcuauugugcgcggccaagaagaaguggaggcaacgucaaaauucguaauacccugcacgggcggaaucacagaccgccucaagaaagacuggggccucaaugacauuuggaacaaccuaguaagcccgcgcuuccaacgaaugaacgcccuaacuggcucagaauacuucggacacugggaaaacaaagagggaaaacgcgucuuccaaacaacuaugccuauacagcuccaacaagguuucagcaagaaacggauagaccaccgccaccacgcgauggaugcacucgucauagcaugcgccucccguaacaucaucagcuaucuaaacaacgagaccgcccaagauaccgaacgacgcagggaucuccgccaaaaacucugcgacaagggcggauccgucagaaaaccgugggauucauucacgcaggacacgcaauacgcccugaaggacaucaucgugacauucaaaaacuacguacgcaucaucaacaaagccacaaacuacuacgaacacuacaagacugacgguaaaaagggcaugauuagccagaaaggcgacgaauugugggcaauacgaaaacccaugcacaaagagaccguuuucggcaaggugaacuugcggcgacccaagcgagucucccuauccaaagcgauagacucugucgacgucauaugcaaucggaaauuaaagaaauacauuaaagccagacucaaugagggccuacaaaagaaacagauacucaacauauuuaaagagguuaacaacgucugggaggggauugacguaaacaaaaucgacauaugggaaaugagcaacgacaaagaaccaaugguagcaacuaggaaacaacuugacaccagcuucgacgagaaaaagauccgcuccaucuccgacacaggaauacagaaaauucugcuaaauuaccugaucaccaaaaauaacaaucccgaacucgcauucacucccgaaggaauccaagaaaugaacagcaauauaucggaauacaacgaccacaagaagcaccaaccuaucuacaaaguaagagucaccgaaccacucggcgccaaauaccccaucggaacaaugggcaacaacccaaagaaauucgucgaagcccaagccggcaccaaccucuacuucgcuaucuacgaagacaaagagggcaaucgcaauuacgacacgaucccgcugaacaucgccgccgagcgccucaaccagcagcugagcccaguaccagagacaaacgagaacaauacaccccuuaaauucuaccucucaccuaacgaccucgucuauguuccauccgaagaagaacggcauuccggcaacaauauucaguuagacaagaacagaaucuauaaaauggucuccaguaccucgaagcaaugcuucuucauacaucaccgggucgcaauaucguuaguugacaagaaagaguucagugcccagaacaaaauggaaagaagcauagacaacgaacaagucaugaucaagucagucugcuggaaacuuaucaccgaccggcuaggcaacaucauaaaagucaucaaguga

SEQ ID NO: 6883 - RNA, 4458 nt, Artificial Sequence
  Cas9 variant
augaagaacauacucggucuggaucugggcacuaauucgauuggcugggcaaagauuuccauagacgacaacggcaaauacaucaaagacuccauaaaacuuggaagcagaaucauccccaugucacaggacguccucucaaauuucagcaaaggugucacacucagccaaaccagcgagcgaacgaguuuccggggcgccagaagacuccgagaacgaacucuguuacgccgagaacgacugcaccggauacuccaucugcucggguuccuccccaaacacuacgagaaggcgauaggaugggaccgcaacgacaacaagacguacggcaaauucaucaaccacgcagaacccaagcuggccuggugcaaagacaacaacggcaagaugcgguucuuauucauggacagcuuucacgauaugcucagcgaguucagcgaaaaacacccugaacugcucgccaauggcaaaaagaucccccucgacuggacuaucuacuauuuacgcaaaaaggcgcuauacaaggcaaucacaaaagaagaacucgccuggauccuccuuaacuuuaaccaaaaacgcggcuacuaccagcuacguggcgaggaggaccgcgacuccgaggcaaacaaaaaggaguaucucgaacuaaaggucauaggcgucgaggcuacaggagagaaaaagggcaacgauauaugguauaauauucaccucgaaaacggcuggaucuaccgacgaucuucuaaaaacccccugaacgacuggcuagggaaagucaaguccuucaucgugaccaccgaccuagacgcagacgggaacccgaagaaagacaaagacgggaacauaaaacgaucuuuccgcgcacccagcgaaggagacuggacacugauaaagaaaagaaccgaaucccuccucgaaaauucgggacaaacaguuggacaauucaucuauaaccauauccuggaggaacccagcgccaagauacgcggcaacuuuauccgaaccaucgaacgaaaauacuacaaggacgaacugaaggcaauccuugaaaagcaaaaagaguuccaccacgaacucagcucugagucacuccuaacggaaugcgcaaaagagcuuuacaagcggaacauagcacaccaggagguucuccucaaaaagggcauaauccaccuucuacucaacgacauccuguucuaccaacggccacuaaagaucaagaaaucgcuaaucgacaacugccccuacgaaaauuauaaauaugucgacaagaaauccggugacaucaaaguuaaauccauuaaaugcaucgcgaaaaguaauccguucuuccaagaguucagacucuggcaauuugucagcaaccuucgccuauacagaaaaucagacgauaaggacgugaccagcgaacaccuggugacaaccgacgacuacgccaaucuauucacauaccucaacaaccgcaaagacaucaaacaauccguccugcucaaggaauacuucaaaauuaagaagguaaagaccaucaacggagccgaguacccagugcgcuggaacuauaucgaugaugacaacaagacguacccaugcaacgagacccguuacgauauauuacacgcccuaucaaaaaccgaacuaaaaagcgaauggcucacaccagaacgcaccuacaggcucuggcaccuacucuacagcauagaaucaaaggaagaaacgaaaaaggcccuaaacaaacucaauuuaucagacgacuucacagaggccuuccuaacaauaaaaccauucaagaaagaguacggaagcuacuccgagaaagcgaucaagaaacugcucagccucaugcguaugggauacuuguggucagaagacgaggccauuaaacaaguaggcgccgaaaucgagaaaacaaucgaaggcgaacugcccgacuacguccuccaacgccuggagaaaagccagcacaacuacaacaagauaucagacuucagcggccucccucuuuggcuugcuucauacaucaucuacggccgccacagcgaagcgaaggagauaauccacugggacaaccccgagagcaugauggcauacaucaaggacuuccggcaacacucgaugcgaaacccaauagucgaacagugcguucuggaaacacuacgcacggugcacgacauauggaaagagauaggccacaucgacgagauacacauagaacucggacgcgaaaugaagaguacuucagaacaacggaaagcgaucacccaaaacguccuccacaaccagaacaccaacauccgaauaaagcuacuucuacaggaauuaaagaaugauaacaauauuaccgggguaagaccuuauucgcccaugcaacaggaaauacuaaggaucuacgaagaaggagcacuacagggccucacaaaagaagacaaagauuacaacgauauacucaaaauaucacagacagcccaaccgacauccaacgagcucacccgauacaaguugugguuagagcagaaguacagaucaccuuacaccggaaaggccaucucacucagcaaacuguuuaccucggcguaccaaaucgaacacgugauaccacagucaagauauuucgacgacucacucagcaacaaaguaauuugcgaaucagaggucaacacacucaaaaaggccaugcuaggcauggaguucauuaaaacaugcggcggccaaaagguacacuguacacuacucggcgacgucgaaauuuacaacgaggaagacuacaaagcguucgugaacgagcacuacagcaacaaccgaaccaagcgaaacaaacuccugauggaagauauuccacaagaauuuauaaaccgacaacuaaacgacucuagauacaucuccaagaugguaaaacagcuccuaagugcgauaguccgcggacaggaagaagucgaggccacgucuaaauucgucaucccaugcacgggcggcaucaccgaccgguugaagaaagacuggggacucaacgacauauggaacaaucucgucagcccacgauuccaacgcaugaacgcccucacaggcagcgaguacuuuggccacugggaaaacaaagaggggaaacguguauuccaaacaaccaugccgauucagcuacaacaaggcuucagcaagaaacggaucgaucaccgccaucaugccauggaugcacuggugauagccugcgcgucacguaacaucauuagcuaccucaacaacgaaacugcacaagacaccgaacgccgacgggaccuucgccaaaaacuaugcgacaaaggaggaagcguacgcaagccaugggacucauucacccaagacacacaguacgcacugaaagacaucauaguaaccuucaaaaacuaugucagaauaaucaacaaagcaacgaacuauuacgaacacuacaaaacugacggaaagaaaggaaugauaucccaaaaaggggacgagcugugggccaucagaaagcccaugcacaaagagacagucuucgggaaagucaaccuuagaagacccaagagaguaucccucagcaaggccauagacucgguugauauaauauguaaccgcaagcucaagaaguacauaaaagcacgacucaacgaaggccuccaaaagaaacagauacucaacaucuucaaagaacugaacaacguaugggagggcaucgauguuaacaaaaucgacauaugggaaauguccaacgacaaagagcccaugguagcgacgagaaaacaacucgacaccuccuuugacgaaaagaaaaucagaagcaucagcgacaccggcauccagaaaauacuacuaaacuaccugauaaccaaaaacaacaaccccgaacuagcauuuacuccagaaggcauccaagagaugaacuccaauaucagcgaguacaaugaccauaagaaacaccagccuauuuacaaaguccgaguuaccgaaccacuaggggccaaauacccaaucggcaccaugggaaacaauccaaagaaauucgucgaagcccaagccggcaccaaccuguacuucgcaaucuacgaggacaaagaaggcaaaagaaacuacgacaccauaccacucaacauagccgccgaacggcuuaaucaacaauuauccccugucccagaaaccaacgagaacaacacaccacuaaaauucuaccuaaguccgaacgaccuuguguacguucccagcgaagaagaacggcacagcggaaacaacauccagcucgauaaaaaccgcaucuauaaaauggucucaucaacaagcaagcgcugcuuuuucauacaccaccgcgucgcaauaagccuaguagacaaaaaggaguucucagcacaaaacaaaauggagcgcagcauagauaacgaacaggugaugauaaaaucggucugcuggaagcucaucaccgaccgccugggcaauaucaucaagguaaucaaauga

SEQ ID NO: 6884 - RNA, 4458 nt, Artificial Sequence
  Cas9 variant
augaaaaauauccuggggcuggaccuuggaacaaacagcaucggaugggcgaaaauuucgauugacgacaacggcaaguacauuaaagacucaaucaagcucgggagccgcaucauccccaugucacaagacguacucagcaacuucuccaagggcguaacucucagccaaaccuccgaacggacuuccuuccggggcgcucgccgccuccgugaacgaacacuccugagacgcgaacgacuacaccgaaucuugcaccuacuaggcuuccucccaaaacacuaugaaaaagccauaggcugggacagaaacgauaacaagacuuacgguaaguucauuaaucacgcggaacccaaacucgccuggugcaaggacaacaacgggaaaaugcgcuuccuauucauggacagcuuucacgacaugcugucagaguucagcgaaaagcaccccgaacuucuagcuaacggaaagaaaaucccucuagacuggacgaucuacuaccuccgcaagaaagcccuuuacaaagccaucaccaaagaagaacucgcuuggauccuccucaacuucaaccagaaaagaggguacuaucagcuuagaggagaagaagaccgggacucagaagcaaacaagaaagaguaucuagagcucaaagucaucggagucgaagccacgggggagaagaaagguaacgauaucugguauaauauacaccuagagaacggauggaucuaucgcagguccagcaaaaauccccucaacgacuggcucggcaaagugaagucguucaucgucaccacggaccucgaugcggacgguaaucccaagaaagacaaggacgguaacauaaaacgaucauuccgcgcgcccagcgaaggagauuggacccucaucaaaaagcguacagaaucccuccucgagaacucuggccagaccguugggcaauuuauauauaaccacauccucgaggaacccuccgcgaagauacgcgguaacuuuauacgaacuaucgagaggaaauacuacaaggacgagcugaaggccauacuggaaaagcaaaaggaguuccaccacgaacuuucaagcgaaagucuacuaacagaaugcgccaaagaacuauacaagaggaacaucgcccaccaggagguccucuuaaagaaagggaugauccacuuacugcucaacgauauacuauucuaccaacgcccacucaagaucaagaaaucacucauagacaacugcccauacgaaaauuacaaauacgucgacaagaaauccggcgacaucaaagucaaaagcauaaaauguaucgcgaaaaguaaccccuucuuucaagaguuccgccuguggcaguucguaagcaaccuccgacucuaccguaaaucagacgacaaagacgucacgucagaacaccugguaaccacagacgacuacgccaaccuauucaccuacuugaauaaccgaaaagacaucaaacagucuguccuacucaaagaauacuucaaaauaaagaaagucaaaacuauaaacggggcagaauaccccguccgcuggaacuauauugacgacgacaacaaaaccuauccgugcaacgaaacgcgcuaugauauccuccaugcucuaucaaaaaccgaacuuaagagcgaauggcucacuccugaaaggacauaccgccuguggcaccuacuauacuccaucgagagcaaagaagaaaccaagaaagcccuaaacaaacucaaccuaucugacgacuuuacagaagccuuccugaccauaaaaccauucaaaaaggaguacggaagcuacagcgagaaagcaaucaagaaacuccuaucccucaugcgaaugggauaccuaugguccgaagacgaagcaaucaaacaggugggcgccgagaucgaaaagaccauagagggcgagcuacccgacuauguacuacaacgcuuagaaaagucccaacacaacuacaacaaaauaagcgauuucagcggccuaccgcugugguuggcuucguacauaauauacgggcgccauucggaagcgaaagagaucauccauugggauaaccccgagagcaugauggcauacaucaaagacuuucgacaacacucaaugcguaaccccauagucgaacaaugcguccuagaaacgcuaagaacggugcaugacaucuggaaggaaauugggcacaucgacgaaauacauauagagcucggccgcgagaugaaaucaaccagcgaacagcgcaaagccaucacccaaaacguccugcacaaccaaaacaccaacauccgaaucaagcuacugcuacaagaacuuaagaacgacaauaacauuaccggcguacgccccuacucaccaaugcaacaggaaauccuaagaauauacgaggaaggggcccugcaaggauugaccaaggaggacaaagacuacaacgacauccugaagauaucccagaccgcccaaccaaccuccaacgaauuaacacgguacaaacucuggcucgaacaaaaauaccgcagcccguauacgggcaaagccaucagucugagcaagcucuuuaccuccgcauaccaaaucgaacacgucaucccccaaucucgguacuuugacgacucacuaucaaacaaagucauaugcgagucagaggucaacacacucaaaaaggccauguuaggcauggaguucauaaaaaccugcggcggacaaaagguucacugcacacuccucggggauguagaaaucuacaacgaggaggacuacaaagcguucgucaacgagcacuacagcaacaacagaacaaaacgaaacaaacuccucauggaagacauaccgcaagaguucaucaaucgacagcucaacgacucccgauacauuucuaaaauggugaagcagcuacuaagcgccauaguaagaggccaggaagaaguggaagcaacguccaaguucgucauuccaugcaccgguggcauaacagaccgccugaagaaagacuggggucuaaacgacaucuggaacaaccugguguccccaagauuucaaagaaugaacgcacucacaggcucggaauacuucggccacugggagaauaaagaagggaaacgcgucuuccaaacaaccaugccaauucaacugcaacaaggguucucaaagaagagaauagaucaccgacaccacgcuauggacgcccucgucauagcaugugccagccgaaacauaauauccuaccucaacaaugagacugcacaagacaccgaaaggaggagggaucuccgccaaaaauuaugcgacaaagggggcagcguccgcaaaccgugggacucauucacccaggacacucaauacgcucucaaagauaucaucgugaccuucaagaauuacgugcgaaucaucaacaaggccacuaauuacuacgagcacuacaaaacggacggcaagaaagguaugaucucccaaaaaggcgacgaauugugggccaucagaaaacccaugcauaaagaaaccgucuucggcaaagucaaccuacgacggccuaagcgaguaagccugucaaaggccauagacucgguagacguaaucuguaaucgaaagcugaaaaaguacauuaaagcacgacuuaacgaaggccuccaaaagaagcagauccucaacaucuuuaaagaacucaacaauguaugggaagggaucgacguaaacaaaaucgacaucugggaaaugucgaacgauaaagagcccauggucgccacucgcaaacaacucgacaccagcuucgacgagaagaaaauccgcuccaucucggacacaggcauccagaaaaucuuacucaauuauuuaaucacuaagaacaacaaccccgaacucgcauucacaccugaggguauccaagaaaugaacuccaacauaucggaguacaacgaccacaaggaacaccaaccuaucuacaagguccgcgucacugagccccucggcgccaaguacccaauaggcaccaugggaaacaagccaaagaaguucguagaagcacaagcaggaacaaaccucuacuucgccauuuaugaagacaaggagggcaaucgcaacuaugacacaauaccccucaacaucgccgcagaaagacugaaccagcaacucucuccugucccagagacuaacgaaaacaacacaccgcuaaaguucuaccucagccccaaugaccugguauacgucccgagcgaagaagaacggcacucaggaaacaacauccaacuagacaaaaaccgcauauauaaaauggucuccagcacaucaaaacagugcuuuuucauccaccauagggucgccauaucccuagucgauaagaaagaguucucagcccaaaacaaaauggaacgcuccaucgacaacgagcaagugaugauaaaauccguaugcuggaaacuaauaacagaccgacucggcaacaucaucaaagucaucaaauga

SEQ ID NO: 6885 - RNA, 4461 nt, Artificial Sequence
  Cas9 variant
augaccaagaucuugggccuagaccucggaacgaacagcauaggcugggccauccgcgaagacgaaaacgaaggcgucaaccaaaucaucgauaaaggggucagaaucuucucagaaggaguaaaaagcgagaauggaaaggagaucuccagggcagccgaacgcaccgccuaccgaagcgccagaaaaauaaaguaccggagaaaacuccgaaaguacgagacgcuuaagguccucagcgucaacggcauguguccacucuccguagaggagguagaacaguggaaaaagucgggcuucaaggaguauccgcuaaaccccgaguuccucaacuggcuccgcaccaacgaggauaaaaauauaaacccauacuucuuccgcgauaaggcgagcaagcaaaaggucacccuauuugagcucgggcgugcccucuaccacauagcacaacgucgcggcuuccugucaaaccgccucgaccaaucggcggaaggcguauucgaggagcacaacccccaaauccaaaaccucauagaggaccuggacucaucgaacacaauucucaacgaacuuaaagaguacuacauaaaucuaggaauaauagacgaaagcgagaaaucaggauucaaaaaggaccucgacgaaggcgaaaagaaccuaaagaaacucuacaccagccuagucucaauaacaaagaaaaaugccaacgacaucgaaaccugcaaacaagaacucaucgccaggcucaacaagaaagaggaccugggcaaagucaaaggcgaaaucaaagacaucagccaggcuaugcuagacggcaacuuuaaaacccugggccaauacuuuuucucauuauacaauaaaacaagaauacguaaccaauacaccucccgugaggagcacuaucuagaagaguuuaucaucaucugccagacgcagggcaucgaggaaauaaacaccaacgagaaacuccccgagaagaaauucacugggcuggccaaagaccuuuaccgagccauauucuuccaacgaccacuaaaaagccaaaaaggccucauuggcaagugcuccuucgagaaaaacaaaagccgcugcgccgugucacaucccgacuacgaagaguuccgcauguggucauacuuaaauacgaucaaaauaggcacacaguccgagaaaacccuacguuuccucacccucgaagaaaagcugaagcuaguccccaaauucuaccgcaagaacgacuuuaacuucgaaguacucgccaaagaguuggucgagaaaggggccagcuucgguuacuacaaaagcuccaagaagaacgaauuuuucuacugguucaacuacaagcccacggacagcgucagcgcaugcguggucagcgccagccuggagaaugcaaucggaaaagacuggaaaacaaaaaccuuugaauaccagacuuccaacacaaagaaagaagaggugaccaaaucgguaaacuacaaagaccucuggcaccuccucucagucgcgaccucggacaccuaccucuaugacuucgccauagagaaauugaaacucgagcccaaaaacgcuaaggcauucagcaaaaccaagcuaaagaaagacuucgcaucgcucucacuagcggcgauugccaaaauacuaccauaucucaagcagggccuccucuacucccaugcgguauucaucgccaacauagaaaauauagucgacgcagacauauggaaggacaaagaacaacagaaguucauccaauccaagauaguggaucucauagauaacuaccuggucgagaaauccaaacuagagaucauaaacugccuucugaagaucuacaauaccgaagacaucgaggggaggaagguauacuacuccaaggaagcagagagccuauuugaggccgaccuccgcaaaaaguuaguacccuucuauaaagccaacaccauauccgaacagcaagagcaagaaaucaucuucaaggaucuuuuuccaguccuaauugaacaacuuaagaaacaagaguucauaaaaaucguaagacuggacaagaaaaucgaagccuuucugaagggagaaaacgaagaaggacagauauucugcaacuaccccgaaaaauucaagaagcuauaccauccgagcgacaucgaggucuucaaaaagaaaaucaucaaggaugaaugggggaacgagaaggucguccucggcaguccacugacgaccuccaucaaaaacccaauggcaaugcgagcccugcaccaacugcguaaaguccuuaacacccucauauuggacggccaaauagacgaaaagacacggauccacauagaaauggcaagggaacucaacgacgcgaacaaacgaaaaggaauccaagacuuccagaaggaacgagaagaacucuauaaaaucuaugaggccaaaaucaaagaacucuaccaagucaagaccggaaaagaauugcuccaugucacagacgaggaccugcagaaauucgaaugggcccuggaacaaaccaaggacggccguaucaucaccaaagaggagcuaaucaaauacaagaucugggaagaacaaaaccacauuugcauauacaccgggaagacaauaucgauagauagcuuccucggcggaaacccaaaguucgacaucgaacacacaauaccacguagcauaagccaggacaacucccuaaugaacaagacacugugcgauaaagauuucaaccgcagcgugaaggggaaaaagaugccaguggagcugucuaacuauaacgagauacucccccgcaucgcucacuggaagaagcaggcggaagaauugacaagacaaauagaaaccauauccagaagcaucaaaagcgccgcgacaaaaguagccaaagauaaaaauauucgcaagaggcacuaccucacacuaaaaagagacuauauccaaggaaaguacgaccgcuucacauggggagaaccgaaagucggauucaagaacucacagaucccggacacuggcaucaucacaaaguacgcccaagccuaccuaaaaagcuacuuuaaacgaguagaaagugugaaagggggagcggucgccgaauuucggaaacucuggggcauccaggaguccuucaucgacgaaaacggauuuaaacauuucaaagaaaaagaccgaagcaagcacacacaccacacgaucgacgcaauaaccauugcaugcaugcccaaggacaaguacgaucuccuagcacacgccuggcgccucgaggacgaacagaacaagaaagcagcaaaggcuuugaucgaacaagccaaacccuggaaaacauucaaagaggacauugagaaaaucgaagcugaaauccucguaucccacuucaccccggacaacgucaagaaacaagccaagaaaauccuccgcguaagaggcaagaaacaguacguggccgaaauugagcgaaaugccaacggaaaagccaucccgaagaaagacgcguccgggaagaucaucuacaagcucaacgaacgaggaaacaaaauucccauacugcagcaaggcgacaccaucagggggagccuacaucaggauagcauauacggagcgaucaaaaacccccucaauacgaacgaaauacgcuacgucauacgaaaggaccuggaaucuuugaaagcgaacgacaucgaaaacaucguagacgaaaacgucaaggcaaaagucaaggaagcagucgcgaauaaaauacugcugauuagcuccaacccacagcagaaaaauaaauucgcagaagguaaaaacgucuggaugaacgaagagaagaaaauacccaucaacaaagucaggaucuacgccaauagcgugaaaaacccaauagagauaaagaaacacagcacacuguccaaaucaaaacacgagcacaaacagacagucuacggacaaaacgaugaaaauuacgcuauggcacuuuacgaacuagacggaaaacgcgaguucgaacuaauaaacaauuucaacuuagccaaacuacucaaacagggccaaggcuacuacccccuccacaaagaaaaagaaauuaaaggcaagaaaguacucauaccgaucgagaaacgcaacaaccgcgacgucguacucaaacggggacaacagguagucuucuacgacaagacggucgaaaauucaaaagacauaagcgagauaguagacuuccgcggccgcguguaccugaucgagggacugacuauccaacgccaaaaggacaagaaaaccgggaaagucaaugaauacggaaucauucagcucagauauuuuaaagaagcccgcaaauccgaagaaaucuccaaggacagcuucaaaccggacggugaguuuaaaauaaaugagaacaaacccacaaggaaaaugaaucacaaccaauucacggccuuuguggagggaauugacuucaaaguccugcccucaggcaaauuccagaaaauauga

SEQ ID NO: 6886 - RNA, 4464 nt, Artificial Sequence
  Cas9 variant
augaaaaacgucuuaggacucgaucugggcagcaacuccguuggcugggcccucgucaaaaccgaggacaauggaaacccgauuggcucgauuaagaugggaucacgaaucauaccaaugagccaagacauacuaggcuccuuugaaaaaggggacacaguuucacaaacggcucagcgcacacucuaucggggcaagcggcgccuaauagagcgacacguacuaaggcgcgaacgccugugccgcguccuucacaucaugaacuuccuaccagaccacuucgauaagcuccucggcugggacaagaccgacaacaaaacauaugggaaguucauagacgacucagagccgaagcucgccuggagacaaaacaaaaaugagaaagagaaaauggaguucguauuuauggacagcuuucacgaaaugcucagugacuuugcaaagcaccaaccacaacucaucgccaauggcaagaaagucccccucgacuggacaaucuauuaccuuagaaagaaggcacucacccaacugauauccaaagaagaacuggcauggauacuccucaacuucaacaaaaagcgcggcuacuaucaacuccggggcgaagaagaagaagaacagcccacuaagaaggaagaguacaagguccucaaagucaucagcguagacgcagaugaagggcaaaagggcaauggcauaugguacaauauacaccuagaagacggcggcauuuacaaacgaaaguccgacacaccccuuuacgauugggugggcaaaacccuccaacugauaguagucacaauauacgagaaagacgguaaaacucccaagauauucgauuccggaaaacagaauccgucauaucgacuccccaaggaagacgacuggggccuaaucaaaaagcgaaccgaaucccaaauucaauccucaggcaaaacugucggugccuucaucuacgacaacauccucagcaaacccgacgacaagauucgcggaaaccucguccggaccaucgagcgcaaguacuacaagaaagaacuuaucgaaauacuccagcagcaagccaaauaccacgacgaacuccacaaccaaaacuuacuagagaguugcgcaaaggaacuauacgcccacaacgacguccgauacaacgagguagucaaaucaaauaugauacaccuuuuagucgacgacaucauauucuaccaaagacccuuaaaaaguaaaaagagccuuauagcuaauugcaaauacgaguccuacgaguacguagacaaagagacaggcgaaguuaaagaaaugcccaucaagugcaucgccaaaucaaaccccuauuaccaagaguuccgucucuggcaauucauacacaaccucagacugucagacgucgucacacgggaggauguaacagcacaauacuugucaaccccacaagacuacuguaaccuuuucaccuaccucaacgaccgcaaggaaauaaagcaggacauccuccugaaagacuucuucaaaaucaagaaaguucagaucgauaaggaaaagguauuuccaaucgaauggaacuauaucaaagacgccacgaaaacauacccgugcaacgaaacccgcuaugagcuccuaucagcucuaaagcgcgcagggauggacaaacaauggcuggacgacaccccaaauaugcaauaccggcucuggcaccuccuauacucaguugaggaacaagaagagucagccaaggcccuccgaaaauuguacgacaacgauaacuucguuagcagcuuucucaaaauaaaacccuucaagaaaugcuacggcgccuacagugagaaagcuaucaaacgacuccucacucucaugcgaaugggaaaagccugggacgaacaagccauugacgccaaaacgcugaaaugcauucaacaaauaaucaccggaaacaucgacagcaaacucaaggagaaaaucgacgacagccgauacguccuccaccacgucagcgauuuucaaggcuugcccacauaccuagccaguuaugucauauacgguaggcacuccgaagucaccgacauaagauguugggacacccccaaggaccuucucaaguucauaugcggauucccacagcacucccugagaaacccaaucgucgaacaaguaaucuuagaaacccuuagaguggucuaugacauauggaaagcugagaagcacauugacgaaauccacgucgaagucgcucgagagaugaaacugacagcacaacagagaaaugaggccaaccuccguaaccucaacaacgaagccacaaaccugaggauaaaguaccuccuagaggaacucaaaaacgacaccuucauaaaggacguaagaccucuguccccgaugcaucaagagaagaugcgcauauaugaacaagcaguccuggggaaccuaaacaagcaagacaaagacuacgacgacauaauaaaaauaucaaagaaagaaagaccgaccuccgcggagcucauccgguacaaacucuggcuagaacagaaauacuguucucccuacaccggaaaagcaaucucauugucaaaacucuucacgacugcauaccagaucgagcacguaauaccccagucucgauacuucgacaacuccuucaacaacaaagucauaugcgaaucagaaguaaacaaagaaaaagacaagaugcuaggauacgaguucaucaagggccgcgggggagaccggaucuacugcacggcccacggcaaagaggucacuauccuuaaagaagaggaguauaagcaauucgucaaugaacacuacgcccacaauaagagaaaacgcgacaaucuccuagcggagaacaucccagaaucauuuagcucucgacaacugaacgacacccgcuacauuacaaaaacgaucaugucccuacuauccaacguagugcgucagcaaggggaagaagaagcuacagccaaaaaccucuugccguccuccggagcaguaacugacaaacugaagaacgacuggggacucaaggacgucuggaacaccaucgucacaccccgguucgaaagacucaacaaacucucuggcacaaacgauuucggagaaaugaaagaggagaauggcaaccguuacuuucagacgaacguaccgagcgaauacgaaaaaggguucaaaaagaaacgaaucgaccaucgacaccaugcuauggaugcgcuaguaaucgcaugcaccacaagaaauauggugaacuacaucuccaacgucaaugccaacucacccaaacagcgcgaagaucucaggcaacuccucugugauaagaaccgcaucaucaacaaaccuuggaacacauucacgcaagacgcccuaaaagccuugaacgacaucgucgucuccuucaaaaacaacgugagaauaauuaaccgagccacaaaccgcuaccaacgcuacgacaaaaacggcaaaaagaugauauguucccagaaaggaaaugauaugugggccauccgaaaauccaugcauaaagagacaguguucgggcgaguaaaccucaucagaaaagaagcccuacccaucgccaaagcccuggacaacaucuccgccaucuguaacgcccaacuccgagccuacgugaacgaccuaguggacaagcacuucaacaagaaacagcucguugcccacuucaaaagccuagacuacaaauggaaccgacaagacgucagcaaaguagagguguggaucaguucggacgacaaaacaccaauggucgccgugcgcaaaccccuagacaccagcuucgacaaaaagaaaaucgcgagcaucaccgacaccgggauccaggcaauacuuuugaacuaccuagaauccaaaggcggggacgcccucgucgcguucgcuccagaaggcauacaggaaaugaacucgaauaucgaauuguacaauaacggaaaagcgcacaaaccaaucaaaaacgucagacuaagcgaaacauuaggggcaaaauaccaaguuggagaacgcggggcuaagaccaagaaauauguugucgccgacaagggcaccaaccuguucuucgccauauacgaagacgaagaggggaaacgcuacuauuacucgguaccacuacgcgaagccaucgaaaggcaaaaacaaaaguuauccccagucccagaauacaacgaaaaaggaguggcccucaaauucuaccugagccccaacgaccuaguguacgucccaacagaggaagaacgaacgauggggacaugccacauagacaaaacccggaucuacaaaauggucucgagcagcgaaaaccgaugcuguuucgucccgagcacaauagcuaaaguuaucgcagacaagguagagcugcucucgcacaacaaaauagaaaaagccauuacgggcgagagcaucaaagaagucugcuggaagcuaaaggucgaucgacuaggcaacauccucaacgucaucaaguga

SEQ ID NO: 6887 - RNA, 4464 nt, Artificial Sequence
  Cas9 variant
augaagaacguacucggccucgaccucggcucaaacaguguagguugggcacuugugaaaacugaagacaacggcaaccccaucggcucaauaaagaugggcagucggauaauacccaugucacaagauauccuaggcagcuuugaaaaaggcgacacggucucucagaccgcccaacggacguuauacagaggaaaaagaagacuaacggaacgccacguccuccgucgcgaaagacuaugucgagugcuccacaucaugaacuuccuacccgaccacuucgacaaauugcucggaugggauaaaacugacaacaaaacauaugggaaguucaucgacgauuccgagccgaaacucgcguggcgccaaaacaaaaacgaaaaagaaaagauggaguucguauucauggauucauuccacgaaaugcuuagcgauuucgccaaacaccaaccacagcuaaucgcgaacggcaagaaagucccccucgacuggacaaucuacuauuuacgaaagaaagcgcuuacucaacuaauauccaaagaagaacuggccuggauccuacucaacuucaacaaaaagcgcggguauuaccagcugcgaggggaagaggaagaggaacaacccaccaagaaagaagaguacaaagugcucaagguaauuuccguagacgccgacgaaggccaaaaaggcaacggcauaugguacaacauccaucuagaagacgggggaauauacaaacggaaauccgauauaccgcuauacgacugggucggaaagacacuccaacugaucguagucaccaucuacgaaaaagacgggaaaacgccuaaaaucuucgacucgggaaaacaaaaucccucauacagacuccccaaagaggacgauugggggcucaucaagaaacgaaccgagucacaaauacagagcuccggcaaaaccguaggugcauucauuuacgacaacauccucucgaaacccgcggacaaaaucagaggcaaccugguccgcacgaucgaacggaaauacuacaaaaaggaauuaauagaaauccuccaacagcaagcgaaauaccacgaugaacuucacaaccagcaccuacuagaguccugcgccaaagaacuauacgcgcacaacgacguccgcuacaacgaaguaguaaagagcaacaugauccaccuacugguggacgacauaaucuucuaccagcggccgcuaaaaucaaagaaaucccucaucgacaacugcaaauacgagagcuacgaauacgucgacaaagagacgggcgaagucaaagaaaugccaauuaagugcauagcaaaaagcaaucccuacuaccaagaguuccgccuguggcaauucauccacaaccuaagacuaucggacguaguaacccgagaagacgugaccgcccaguaccuuuccacuccacaggacuacuguaaccuauucacauaccucaacgaucggaaagaaaucaaacaggacauacugcucaaagauuucuuccaaaucaagaaaguccagaucgacaaagaaaaaguauucccaaucgaauggaacuacauaaaagacgccacaaaaacuuauccaugcaacgagacgaaauacgaacuacugagcgcccuaaagagggcaggaauggacaaacaauggcucgaugacacgccgaauaugcaauaccgacucuggcaccuccuauacagcguggaagaaaaagaggaaagcgcgaaagcgcuacgaaaacuauaugacgacgacaauuuuguaucauccuuccugaagauaaagccguuugaaaagugcuacggagcauacagcgagaaagcaauaaagcgccugcuaacccucaugcgaaugggaaaggcuugggacgaacaagcgauagacgcaaagacacucaagugcauccaacagauaauaacagggaacauugacucaaaacucaaggagaaaaucgacgauucacgcuauguacugcaccacguaagugacuuccaaggccucccgacguaccucgcguccuacgucaucuacgggcgccacucagaaguaacggauauacguugcugggacacaccaaaagaccugcuaaaauucaucugcggauuuccgcagcauucacugcggaacccaaucgucgaacaagucauccucgaaacacuaagagucguauaugauauauggaaagcagaaaaacacauagaugaaauucacgucgagguggcccgagaaaugaaguuaaccgcccagcagagaaacgaagcaaaucuacgcaaucugaacaacgaagccaccaaccuaaggaucaaauauuuacuagaggagcugaaaaacgacacauucauaaaggacguacgcccccuaagcccaaugcaccaagaaaagaugcgaauauacgaacaggcagugcuaggaaaccuaaacaagcaagacaaagacuacgacgauauaauaaaaaucucuaaaaaggaacgcccaacgagcgccgaacuaaucagauacaagcucuggcuagaacaaaaguauugcuccccauauacaggcaaggccauaagccugucuaagcuauucaccaccgccuaccagauagaacacguaauaccucaaagcagguacuucgacaauagcuucaauaacaagguaaucugcgaaagcgaagucaacaaagagaaggauaaaaugcucggauacgaguucaucaaggggcgcggcggggaccgcaucuacugcacagcgcacgguaaggaagucacaauucuaaaggaagaagaauacaaacaguucgucaacgaacacuacgcgcacaacaaacgcaaacgagacaaccuucucgcagaaaacaucccggaaucguucuccucccggcagcucaacgacacccguuauauaaccaagaccauaaugucccugcucucgaacguaguccgccaacaaggagaagaggaggccacagcuaaaaaccuacuaccaagcuccggcgcagucacagacaaacucaagaacgacuggggacugaaagacgucuggaacacaaucguaaccccacgguucgagcgccucaauaagcucagcggcacgaacgacuucggagaaaugaaagaagaaaacggaaaccgcuacuuccagacgaacgugcccagcgaauacgaaaaggguuucaagaagaaacggaucgaucaccgccaccaugccauggacgcccuagugauagcauguacaacccguaacauggucaacuacauauccaacgucaacgccaacuccccaaaacagcgggaagaucugagacagcuccucugcgacaaaaaccgaaucaucaacaaaccguggaacacguucacucaggacgcccucaaagcccucaacgauauagucguguccuucaaaaauaacgucagaaucaucaacagagcaacuaaccgauaccagagguacgacaagaauggcaagaaaaugauaugcucccaaaaaggcaacgauaugugggcaauucggaaauccaugcacaaagaaacaguguucggccgcgugaaccugauacggaaagaagcgcucccaauagcgaaggcgcuggacaacauaagugccaucugcaacgcccaacuccgggcuuauguaaaugaccucguggauaaacacuucaauaagaaacaacucguagcgcacuucaaaucgcucgauuacaaauggaaccgucaggacgucagcaaagucgaggucuggaucuccagcgacgacaaaacccccaugguggccgucagaaaaccacucgacaccagcuucgacaaaaagaagauagccucaauaaccgacacaggcauccaagcgauucuccugaauuaccuagaaucgaaaggcggcgacgcccuaguggcguuugccccagaggggauccaagaaaugaacaguaacauagagcuauacaacaacgguaaagcgcacaaaccaaucaaaaacguccgacugagcgaaacgcugggagcaaaguaccaaguuggcgagcgaggagcgaaaacaaagaaauacguuguagccgacaaaggaaccaaccuauucuucgccauuuacgaagacgaagaaggcaaacgcuacuacuauucugucccccuccgcgaggccauagaacgccaaaaacaaaaacuaagucccguucccgaguacaacgaaaaaggcgucgcucugaaauucuauuuaucaccaaacgaccuaguguacguccccacagaggaggaacgcacuauggguaccugucauauugacaaaacacgaauauacaaaauggucagcagcagcgaaaaccgguguugcuucguccccuccaccaucgccaaagucaucgccgacaaaguggaacuacuaucccacaacaaaauagaaaaagcaaucacgggcgaguccaucaaagaaguguguuggaaacuaaagguagaccgccuagggaacauccucaacguaaucaaguga

SEQ ID NO: 6888 - RNA, 4464 nt, Artificial Sequence
  Cas9 variant
augaaaaacauacuagggcucgaccuuggaucuaacagcguggggugggcccuaguaaaagucgaggagaacgguaauccgauaggcagcaucaagauggguucccgcauaauacccaugucacaagacauccugggcuccuucgaaaaaggcgacaccguaucacagacggcgcaacguacccuuuacagagguaaacgcagacugaucgaacgacacguccuccggcgagaaaggcuaugccgugugcuccacauaaugaacuuccuccccgcccacuucgaccggcuucucgggugggacaaaacagacaacaaaacauacggcaaauucauugacgauagcgaacccaaacuggccuggagacaaaauaaaaacgagaugggaaagauggaguucguauucauggacucguuccacgaaaugcucagcgacuucgcgaagcaucaaccccaacucaucgccaacggcaagaaagugccccuggacuggacgaucuacuaccuccgcaaaaaggcacugacucagcugaucuccaaagaagaacucgccuggauacuucugaacuucaacaagaagagaggauacuaccagcuacggggagaagaagaggaagaacagcccaccaagaaagaagaauacaaaguacuaaaagucauuuccgucgacgcugacgaagggcaaaaaggcaacggaaucugguauaauauucaccucgaggacggcgggaucuacaagaagaaaucagacauaccacuauaugacugggucggcaaaacacuacaacuaauaguggucacuacguaugaaaaagaugggaaaaccccaaaaaucuucgauagcgggaaacagaauccgagcuaucgacucccgaaggaggacgacuggggccuugugaagaaacgaaccgagucacagcuacagucaagcggcaaaacagucggcgcguucaucuacgauaacauccuauccaaaccagacgacaaaauaagaggcaaucuaguccgaaccauagaacggaaauacuacaagaaagagcucaucgagauccuccagcagcaggcgaaauaucacgacgaacuacauaaccaaaaucugcuagagucgugcgccaaagaacucuaugcacacaacgacguccacuacaaugagguaauaaaaagcaacaugauaaacuuacucgucaacgacauaaucuucuaccaacguccgcucaaauccaaaaagucccuaaucgccaacugcaaauacgaauccuaugaauacguagacaaagagaccggugagauaaaagaaaugccgaucaaauguauagccaaaaguaacccuuacuaccaggaguuccgccuauggcaguuuauacacaaccuccgacuaucggacguggugacacgagaagacgucaccgcccaauaccucucgacuccacaggacuacuguaaucucuucacguaccucaacgaccgaaaagaaaucaagcaggacauucucuuaaaggacuuuuucaaaaucaaaaagguccagauagacaaggagaaaguauucccgaucgaauggaacuauaucaaagacgccaccaaguccuacccuuguaacgaaacccgcuacgaacuucuaucggcauuaaagcgggccggcauggacaaacaauggcucgaugacacucccaacaugcaguaucgccuguggcaccuguuauacagcgucgaagagaaagaggagagcgccaaagcacuuagaaagcucuacgaugaugacaaguucguaaccucauuccugaagauuaaacccuucaacaaaugcuacggcgccuacuccgaaaaggcgauuaaacgacuccucacacucaugcgcaugggaaaggcuuggaacgagcaggcgaucgacgcaaaaacacuaaaaugcauacagcaaaucauaaccgacaacgucgacaguaaacucaaagagaaaaucgacgacagcagauacguucuucaccauguguccgacuuccagggacucccaacuuaccuagccagcuacguuauauacggacgccacagugaaguaacggacauacagugcugggacucgcccgaagaccuccucaaauucaucagggacuucaagcaacacagccuacggaacccgaucguagaacaaguaauacuggaaacccuccgggucguguacgacaucuggaaggcggaaaaacauaucgaugaaauccacguggaagucgcgagagagaugaaacucacagcgcaacaaagaaacgaagcgaaccuacguaaccugaacaacgaagccacaaaccugcgaauaaaauaccuccuggaagaguuaaagaacgacacauucauaaaagacguccggccccucucucccauucaccaagagaaaaugcgaaucuacgaacaagccgucuuagggaaccucaacaagcaggacaaggacuaugacgacauuauaaaaaucucaaagaaagaacauccaacgaacgccgaacucauacgauacaaacuguggcuagagcaacgguacugcagccccuacacaggcaaggccauaucccucucuaaacuguucacaacagccuacgaaauagagcacaucaucccccaaagccgcuacuucgacaacuccuucaauaacaaagucaucugcgaggcggaggucaacaaagccaaaggaaacaugcuaggauaugaguucaucaagaaacaaggcggacagaaaaucuauuguacccaacucggcaaagcagugacuauucucaaggaagaagcauacaaacaauucguaaaugaacacuacgcacauaauaagcgcaaaagggacaaccugcucgccgaaaacauaccagaauccuucagcagccgccaguuaaacgauacgcgauacauaacgaaaacaauaaugagcuugcugagcaaugugguacgacaacaaucggaagaagaagccaccgccaaaaaccuccugcccuccuccggaagcguaacggaccggcuaaagaacgauuggggguuaaaagacguguggaacacgauagugacgccccgcuucgaacggcucaacaagcuauccgggacgaaugacuucggagaaaugaaggaagaaaacggcaacagauacuuccaaacaaacguaccacuagaauaugagaagggauucaagaagaaaagaaucgaccaccgccaccacgccauggacgcacucgucauagcaugcaccacacgaaacauggugaauuacaucagcaacgcaaaugcaaacucaccaaaacaacgagaagaccuacgacagcuccuaugcgacaaaaacaggauaaucaauaaaccaugggacacguucacgcaagacgcucugaaagcacuaaacgacauaguggucagcuucaaaaacaacguccgcaucaucaacagggccacaaaucgauaccaacgguacgacaaaaaugguaagaaaauaaucuucucacaaaaaggagaugacaugugggcaauacgaaaaucaaugcacaaggaaaccguauuuggccgcguaaaccuaauccgcaaagaagucuuacccaucgccaaagcucuagacaacauaagcgccaucuguaacgcacagcuaagagccuacguaaacgaccuaguggacaaacacuuuaacaaaaagcaacucgucgcccacuucaagagccucaacuacaaauggaacagacaagacguaucaaaaguggaagucuggauaagcucggauaacaaaacaccuaugguggcagugcgcaagccccuagacaccuccuucgauaaaaagaaaaucgcgucgaucacggacaccggcauacagacgauacucuugaacuaccuagaaucaaaagguggcgacgcauccgucgcauucgcaccagaaggcauacaagaaaugaacucaaacaucgagcuauacaacaacggcaaggcacacaaacccaucaagaacguccggcugucggaaccccuaggcgccaaauaccaaguaggcgaaagaggcgcgaaaacgaagaaauacgucgaggcagacaaagggacaaaccucuucuucgcaauauacgaagaugaggaaggcaagagguacuauuacagcgucccccucagagaagccaucgagcgccaaaaacagaaacuaagccccguaccggaauacaacgaaaaaggcgucgcgcuaaaguucuaccucagccccaacgaccuggucuacgucccaacggaggaagaaaggacaaugggaacgugccauaucgacaaagcacggaucuacaagaugguauccagcacgggguguagcugcuacuucgugccaucgacauucgccaaagucauugucgacaaaguagaguuacaaucccucaacaaaauggaaaaagccaucaccgacgaaugcaucaaagaagucuguuggaaacucaaagucgaccgccuagggaacaucaucaauguaaucaaguga

SEQ ID NO: 6889 - RNA, 4485 nt, Artificial Sequence
  Cas9 variant
augaaaaacauacucggacucgaucugggcaccaacagcaucgggugggcacucaucgacaacgagucucaccgcaucauuaaaucgggcucgcgaaucauacccauggacgcagcgacgaugggggacuacgagaaggggaaccugaaaagcgcggacuggaaacgcaccucguuccgcggaaugagacgucuguacgaacgcgccaagcucagacgcgaacgccugcuaagaguguuaaacauccucggcuuccuaccagaggaguuucgucgacaaauagacuuugaacaccacccaggucaauucauagacgguaaagaaccacuaaucgccuaccaccacgacgaaaacggccagaggguauucuccuacaugagcgcauucgaagaaaugcucacagacuuccgcgcgacccagagcgagcuaguacgggacggccgccgcgucccauaugacuggacaaucuacuaccuccgccacaaggcccugacccaaccagugacgaaagaagaacuggcguggaucauacucaauuucaacacaaaacggggauacuaccaacuccgcuccgagucugaagaagugaccacaaacaaaaaugaagaauaugcugaacucaaagugguaucgguggagaaaacgggcgaagacaagaaacgcgcaggcuacuacugguacaccauaacauacgacaaugaagcagaacagaaaauaaccagcaccauaccgccacgacaaauuggcgacaaaguggaacugaucgucaccacggcucgcgacaaagcaggcgaaauaaagaaauccguccguucaccaaaagaggacgacuggacccucaugaagaaacggaccgaacacaacaucgaggaggaagaaugcacuguagguucguacaucuaccaacacauccucgcggaccccaccgucaaagucagagggaaacucgugcacacaauugaacgaaaauucuacaagaaagaacuaaaacagauacucaacaaacaaaaagaguucauccccgaacuucaagaugcgucccuauacgaggcaugcaucaaagaauuguaccgcaacaacgaagcgcacauacaauccauagcaaacaaggacuucaccgaccucuucgucaacgacaucaucuucuaccaacggccacucaaaagcaagaaaucaacaaucagcaacugcccguacgagaguuacuacuacaaaaacaaagagacuggugaacuuauccggaaacccaucaagugcauagccaaaagcaacccccuguaccaagaguuucgguuauggcaauucguccacaaccuacgaauauacaagaaauccgaggaagugucuggacgacuacaaacggacgucgacgucaccgaucguuuccuaacaaccccggacgacuaugcaaaacuguucagcuggcucaacgaucggaaagaaauaaaacaaaaagaacuccugcgcuacgaggcauucggccucucgaaaucauacggugacuaucgguggaacuucguagaagacaaacccuauccuugcaaugaaacccuucacgagauuaaccgccgaaugaaaucaauccuauccgauaaaaagcucuccuccgaggcauaucagcaacucuggcauauccuauacagcaucgacgaucccauagaaauccgaaaggcgcuaaccagcuuugcacaaaaccaggagaucaacagcgacgacuucguaaacgcuuucuaccaauacguacccgagaaaaccaaaucguacggcgcguacuccgagaaagcuaucaagaaacuacucccucuaaugcgccgcggaagcuacugggcaaucgggaacaucgacgaaaagacccacaggagacuugauaacauuaucaacggagucgcagacgacucaauaucaacauguacacgcgaaaaauugaacaaccugacagacauaaccaugugccaagguaugccccucuggcaagccugcuacgccguuuacgauagacacagugaggcagcagauaccacgaagugggaacagcccgacgacaucgacacguacuuguccacagagcucaagcagcacucccuacgcaaucccaucguagagacugucauaucagaaaccuuacgcgucguacgagacaucuggaaagcauauggcaggccagaagagauccacgucgagcuaggacgaaaucugaaacaggacgcaaaaucccguaaacaagacgcaauccgcauggccgaaaaugaacagacaaaucuuagaauacgcgcccuucugcaagagcucucuaaccccgaaugcggcgucgagaacgucagaccacacucaccgagccaaauggagcugcuuaaaauauacgaaaacgagguccuacaauccacggaugacauaccggaagagaucagcaacaucauaaaagaccuaggcaaaacggacagcaagaaacgccccucccugagcgacaucacaaaauaccgcuuguggcucgaacagaaauaccaaagccccuacacaggccacauuauaccgcuuaguaaacucuucaccccagcuuaccagaucgagcacgugaucccgcagucccgauacuucgaugacagcaucucaaacaaagucaucugcgaagcugaaguaaacaaagagaaggaucgcauguugggcuacgaguucaucauaaacaaaggaggcuccauuguaaagggcagcuucggacaacaguucaaaauauucgacaagguccaguacgaagacuuuguaaagcagcgcuaugcacacaacaaaacgaaaaugaagaaacuacuuauggacgacaucccggauggcuucauacaacgccaacuaaacgacucgagauacaugagcaagaaaauaaucuccauccuguccaauaucgugcgcgaagacggcgaaaaagaagccacaagcaaacacaucauugucacaucaggcgccauuaccgaccgccuaaagaaagagugggggauaaaagacguguggaacgacauaauagcgccacgcuucaaacgacuaaacaaacucaccgacagcaacaacuacggcauggagacagagaaggaaggacgccaguacuuucaaaucaacgucccaacggaguuaagcaccgggcuaaucaaaaagcgcaucgaccauagacaccacgcuauggacgcaaucauaaucgcaugcacaacacguaaccaugugaacuuccucaacaacucaaccgccgccuccgaccaaaaagacauucgccgagacuugcaacacacacucugcacaaaaacaaaaaccgauagcaacggcaacuacgucuggagguucaauaaaccaugggacacguucacccaagauaccagacaggaauuagaaggcaucauaguauccuucaaacaaaacuuacgcauaauaaacaaaaugaguaacuauuaccagcacuacguagacggcaggaaaaccaucagccgacagaacaagggggacgggugggcgauccguaagucacuacacaaagcaaccguaagcggaaaagucaaucuuaaaaggagcaagacuguaggcuucaaggaggccuugaacgacugguccgcaaucaaagacaaaacuagcaaagccauccugcagaaaaucaucgcgcaauacaaaaacuacgauccaaaaaccauuuucaaauacuuuaaagacagaaacuucaaagucgaaggcaaggacuucuccaagcucgaaguauacuacaacacaucagacaaagagccaauguccgcacaccgagucaauaucgacaccaccuucgacgagaaagaaauccgauccaucacugacacuggaauacagaaaaucaugcuuaagcaucugcacacauacgacgacgcgcaaggaaagacccaccccgaagccgcauucucaccggaaggaauagagaaaaugaaccaaaauauccgaaugcugaauggcgguaaagaccacaaaccgaucuucaagguacgaaaagcggaaaucuuggggaugaaguucgccgucggggaacgcggucacaaggacaagaaaugggucgaagcagacaaagguacgaaccuuuucuucgcgauuuacgaguccgaggaaaacaaacgauccuacagcagcauaccacuaaaugaagcaauagaccgacucaaacgaggcgagaacaucgccgacgaacgcgaccaaaacggaaacaaacuacuguucguccucucccccauggaucuaguauacguuccagaccccgacgacgcacacaucgacgaggucaaaggcaauaacaauauuuucaaaauggucagcugcacaggaacagaaugcuauuucgucccagaaacguacgccaaugugauuuguaaggggaaagagcucgaaucgaaaaacaaaguggaaagcuacgacggcaucaauaucaagaagucgugcuacaagauaacggucgaccgccugggcaaaguccgaaagaucuucaaaggcuga

SEQ ID NO: 6890 - RNA, 4491 nt, Artificial Sequence
  Cas9 variant
augaaaaccauucuaggacuagacuuagggacaaacuccauaggaugggcaaaaguaugcgucgacgacaacgguaacuaccugcgagacauuaaacucggcucgcguaucaucccaaugucacaagacguacugggaaacuucgacaagggugucacggaaagccagaccagcgugcgcacgggcuuccgcggaguccgacgcauacgagaacggagccuccuaaggcgggaacgccugcacagagugcuacacgugcuaggcuaccuuccuccgcacuacgacagcgcaauaggauggaacaagaacgagccaucgacauacgggaaauuccuaaaucauggagaaccuaaacuagcgugggaacacaaagaagacggcucaaugcgcuucuuauuuauggagagcuuccacgaaaugauggcagacuucgcaaaaagccagccgucgcucgugagcgacgguaagaagaucccacucgacuggacgaucuacuaccugcgcaagaaagcgcugagccaacccauucggaaagaggagcuugcguggcuucuacugaacuucaaccaaaagagaggauacuaccaacugcgcggcgaggaagacgacgauaaccccacgaagugcgaagaguauuacgaacuaaaggucguuggaaucgaagcggacgaggagggcaaaaacggaaauacaugguacaacgucaaacucgaaaacgguuggauauaccgccgccaguccaaaauaccacuggacgacuggaucggcaaaguacgcgaguucaucguuacaaccgaauacgaaaaagacgggauuacccucaaaaaggacaagaacggcgacguaaaacgaucauuccgaagcccaucagaggacgacugggggcuucggaagaaacgcacagaaaaacugcucgacagcagcaagaugaccguaggggcauucgucuacgaccaccuccuggcagaaccgagcgacaagauccgaggcaaauucauccggaccaucgaacgaaaauacuacaagaaagaacuauaugccauccucugcgaacaguccaaauaccacgaggaacugcgauccggcgacuaccugaacaagugcgcggaggaacuauacaaaaacaaucaaccacaccgaaacagccuacuaacgaaggaccucgccuaucugcuccucgaggaccuaauauucuaccaaagaccacugaagaccaagaaauccuuaaucgccgaaugccccuaugaggcguacaaauacguggauaaagaaacuggcgagauaaagcgccagggcauaaaaugcauagcaaagagcaacccauacuaccaagaguuccgccuuuggcaauucauaucaaaccucaggcuauucaacaaggcggacgacaaagaagucaccgccgauuacuuacccacgcaagaugacuacguacgacuguucgcguaccucaacgaccgaaaagaaauaaaucaggaaacccuccucaaagaguucuucaaacugaagaaaaucaccguaaacucggaaaaaguauuucccauccgauggaacuauauagaagacaaggagaagaaauacccaugcaacgaaacacggcacgaauugcuauuggcacuggacagagcgcguauagaucacucauggcuggagaaaccgggacaagaauacagacucuggcaccuccucuacagcguugaaucaaaagaagaaacgaaagaagcccuacggaaauuaaaagacgacgaugcguucguagaaucauuccuaaaaguuaaaccguucaagcgcgaguacggcgcauacagcgaaaaagcgauaaagaaacuccuagccguaaugcggaugggcucacuguggcgggagacagacauaugcgacacaacuaaagggaacaucacaaaaauucuccagggggaaauagacgaaaaauuaaaagagaagauauccgcguccguuucaucuuacaaucaacuauccgauuuucagggccugccagucuggcucgccugcuacgucguauauggccggcacagugaagcggccgaaauacaacauuggaagaccccagaaagccuucuggccuacauuaacgguuuuaagcaacacagccuacguaaccccaucguggaacagugcauacuagaaacgcuacggacgguucacgacauauggaaagaagugggacacauagacgaaauccacguggaacucggacguaacaugaaaaguaccgcggaccaacgugccagaaucucggaaaaugucuuaaggaacgaaaacacuaaccuacgaauuaagucacuccuccuagaacucaaaaacgaccccaacaucaaggacguccggcccuacagccccaugcagcaagagaaacuccgcauauacgaagagggcguacuucaagaacucacaaaggacgacaaagacuucaccgagaucacaaaaaucagcaccauggcccaaccaagcgccaaagaacuccaacguuacaaacuauggcuagagcaaaaauacagaagcccauacacaggcaagucuauaucacucaccaaacuauucacauccgcguaccagaucgaacacgugaucccccaaagucgauacuucgacgacaguuuuucuaacaaaguaaucugcgaaucggagguaaacagccucaaggacaacaugcugggcuacgaguucaucaaaaaccauggcggugaaauaauacacugcacaauguuaggggacgugaaggugcuguccgaaucagaguacaaagcguucgugaaugaucacuacgcccacaauaaacgaaagcgggaaaaccuccugcuagaagauauuccacaggaguuccuaaacagacaaaugaaugacagucgauacaucucgaaaguaguaaaagcacuacuaagcaacauuguaagagccgaaggggaagaagaagcgaccucaaaauucgucguaaguugcucaggcggcauuaccgaccgacuuaagaaggacuggggccuaaaugacguauggaacaagaucgucuacccccgguuugaacgcuuaaaccgucuaacgggcacagaagccuuuggacaaugggaaaauaaagacggaaaaaggguuuuucagacagccguaccccuagaacuucagcguggcuucaacaagaagcggauagaccaccgccaccacgccauggacgcucuaguaaucgcgugcacaagcaggaacauaauaaacuaccugaacaaugaaagcgccaacaacccgaagaaaagagaggaccugagacaaaaacucugcgacaagaacaggacgauccggaagccaugggaaaccuucacgcaagaugccacggccgcacuggaagacguuauugucagcuucaaaaacuacguccgcauaauaaacaaggcaaccaauuacuacgaaagguacgacguggagggcaagaaaguaauagccgaacaacgaggggacgacaugugggcaauccgaaaacccaugcacgaagccaccuacuacggccgcgugaaucugcgacgcaagaagaaaguaaaccuuagagucgcccuugaaaacaucuccagcaucugcgacaacaaacuucgcauauacaucaacggacucgucgaaaaaggauucaauaccaaacagauacucgacaaauucaaaaacacuaacgaccacuucuccaugcagaagaucgacaaaguagagaucuggcaauucaccaacgaagaagagaagcucgucgccacccggaaaccccucgacacgucauucgacaccaagaaaauugcguccaucaccgacacgggcauccagaccauccugcugaacuaccuggagacgaaaggcggagauagcacaaucgccuucaccccggaaggcauaguagagaugaaccaaaacaucagcaaauauaacaacggcaaagaacacaugcccauacuaaaaguacggcucuauaccaaacucggcaaaaagauccccgugggacaaacaggcuguaaagcaaagcaguucguaauagccgaagccggcacuaaccuguacuucgccauauacgaagacgaagaggggaagcgcuccuacagaaccaucccccugaacgaaguggucgaacggcuaaaacaaggccugagcccagucccagagaaaaacgacaaggauguacaccuaaaauucuaucuaucgcccaacgaccucgucuacguccccauagaagaugaacacgaaucacuggccaaagaccacauauacaaauucgucgacagcagcggcacaaccgcgaacuucaucccccaccggucagcaaacguuaucuuugaacuuaacaagaaagacgcugaaaaauucugcagcgggucuaucauccaaaacgaauacggagucggcagcucucagucuaaaaaccaaaaagcgaucacuggagaaaugaucaaagcagucugccgcaaacucgagguggaucgccucggcaacgucaucaagguaauauga

SEQ ID NO: 6891 - RNA, 4497 nt, Artificial Sequence
  Cas9 variant
augaagcacauccugggacuagaccuggggaccaacucgaucggcugggcaguaauccgcgcccaccaagaugcagacgggcauaccacacuccaggauauacucgccgccgggagccggaucauacccauggaugcagcuacucuaaccgacuucgacaaaggaaacgcccgcucggggacggcggaaagaaccucguuccgguccaugcgccgacgccgugaacgccaacugcuccgcagagagcggcuccacagaguccucaugcuccuaggcuuccugccccaacacuacgccaacagucucacccgcuacggagaguucgccgacaaccgcgaauguaagcuccccuggguuaaagacgagucagacgggaaguaccacuuccuauuccaagacgccuuccaugaaaugugcgaagacuuccggcaacuagcaccgcaaugggucgcagauggcaaaaaggucccauacgacuggacacuuuauuaucuccguugcaaagcccuuucacgcaaaauaucaaaggaagaacuugcuuggauucuccucuccuuuaaccagaaacgaggauacuaccaagcgcgagaugaggaggacgagguuaccaccaacaaacuagaagaguacuacgcgggaaaggugguucgaguugacgacacaggagaacgcaagggaaagaacguauacuacgacauaacccucgaaaauggcuggguuuaucgauacgccgccaggaucuacccagacuggguagggcaaguaaaagaguucaucguaaccacaacgcuaaaccccgacggaacaccaaaaacagacaaggcgggagaagucaagcgcagcuucagaaugcccaaggacgacgacuggacacucaucaaaaagaagaaagaacgggacauagacagaucccaagaaaccaucggccaguacaucuaccacgcccuccuuaaagacccgucacagaaaaucagaggcaaacucauaggaaccgucgaacgaaaauacuauaaagacgaacuccgcaggauacucgacagacaaauccaauuccaccccgaacuacgcgaccgagaacuguacuacgccugccuccaagaauuauauccaucgaacguagcauuccgaaacaccuuggucaacagggacuuuaccuaccucuuccuggaugacauccuguucuaccaacgcccccuuaagucaaagaaaagccaaaucuccgauugucccuaugaagaacacuuuuauacagacaaggagacaggagaacgcaucagcguaccagucaaguguaucgcagucagccauccacuauaucaagaguaccgccuguggcaauucauccaaaaccuacgcaucuacugucgagaagcccgaauagacgguaacuuaaugauugacugggaggucaccaacgagcucuuacaaaccgaagaagacaaaaccgcccuauucgacuggcucaacgacaaagaaucagucaaacaaccagagcuaguugcguucuuacucggaggcaaagcaaauaagaaacaaaucaaagcguaccgcuggaauuauauggaugacgacacaaaaggauauccaugcaacgaaaccagagcaagccuccuaaaauaccuacgcgaagcacaaaccgauaguagcuuccuaacccgagaacgcgaggaagcacucuggcacaucuuauacuccauuuccgacaaaggggaacucaaaagcgcacuaggaaaauucgccgucaagcacggccucaacgaacgguuugucaccguauucuccaaguucccaccguucaagaaagacuacggguccuacucggcaaaagcacucaagaaacuacucccccuaaugcgcaugggccaucauuggcaagaagcgagcuucaucccaucuacccggcagcgaauggaaaaauucaucaacggggaauacgacgacuccaucgacaaacgcacauacgaaaaacucgagucccuaacagaagucucacaauacagaggccucccgggguggcuagccugcuacguggucuacgaccggcauagugagggccgcgacaucgaacgauggacgagcccgucggacauagauuccuaccucgcacaauucaagcaacacucccugcacaaccccauuguagaacgcgucguccucgagacacugcgcaccguccgcgacauuuggaagcaaguggaccacauagaugaaauccacauugagcugggucgcaacaugaaacucccagccgauaaaagacgccaaaugaccgagcaggcuuggaaaaaugagcaaacgaaccuacgaaucaaagcccuguuacuugaauuugcgaggcccggcuacgacauugaaaauguccgacccuacagcccguaccaacaagaccagcuccgaauauacgaggaggcugugcucggcgcaaacgaaugcccagacgacaucagcgcaauacuuaagaaauucaacggccucaauccacccacaagugcggaaguccuucgcuacaaaugcugguuggagcaaaaauaccgcucgcccuacaccgggagaaccaucccccucucaaaacuauucacaucagccuacgaaauagaacacauaauuccaaaacaacgguauuuugacgacagcuucuccaauaaagucaucugcgagucggaaguaaauaaaaagaaaggagccaugcucggauacgaguucauaaaauccuaucauggcgcaucuauaacccucaacaggggagggaccgcaucgaucuucuccguggaggcuuacgaaaacuuuguaaaagaacacuacgcucacaaccgaggcaaaaugaaaaagcuacuaauggacgaugugcccgacuccuuuaucucccgucagcucaacgacucgcgauacauuuccaagcuaaugaaaagcaucuugucgaaccugguccgggaagaaggggaaaaagaagcuauauccaagaacuugaucgucugcacaggcggaaucacagacagacuuaagaaagacuggggcauacacgaugucuggaaugacauuaucuucccacgauucaaaagacuagaugaaauggacagcucgcacacuuacauuacacuaaacacccaccgacacccgauaccaagcaugccccucgaauuucaacgcggcuucucuaagaaacgcauagaccaccgccaucacgccauggaugcuauaguaaucgcaugcgcaacacgaaacauagucaauuaccuaaacaacgaaagcgcacgacacgaugccaaaacaagccguauggaccuccagcggcuccuaugcaccgccaaucgcaaacuaauagauaagcccuggaaaacguucacccaagauaccugcaagguccucgaagacaugauugucucguuucaacgaacacuuaggauaaucaacaaaaccaaaaauuauuaccugcgcuucgaagacggaaagaaacgaagagugcuccaaacaaaaggagacaacugggcaauccggaaaccccuacacaaagaaacguucuacggagaaaucaaccuacgccggaucgaaacccucucguuaaauaaagccuuggaaagaauaccagacauagucgaacgcgaccuacgcaagaaacuaagcgaacugcuaagccucggcuacaacgccaaacguauaaaaggcuauuucgaagaacauaaagaagaguggucagacgucaaccuuuccaaaauaaaagcauacuauuucacaaaacaaaagaacaagcgauauuucgccgcaagaaccgaacuggacaccucuuucaacaaagauaagauagagaacaaaauagcugacaccgccauacagaaaauacuccuacaacaucuugaggccuacgggaacgacgucgaacaagcauucucgcccgaaggcaucgacacgaugaaccgcaauauccggcaacucaacggcggucgcucacaccaacccauauacaaaguacgcguuuacgaagaagcaaccaaauucgccguaggccgaagaggcaacaagucuaccaaguucgucgaagccgccaaaggcacgaaucuuuucuucgccaucuacgaaauaucacaaguggacggcaaugggaaccgccaaacuucccgcaccuucucgucgauuccccugaacguggccgucgagcgacucaagcaagggcuaccacccguaccggaagacgaggaaggaaacgcacccaaguacguacuuucccccaacgaccuuguuuaccuaccuacugaaaaagaacucaagcgacgcgagauugcaaugccgauagacaaauccagaauauacaaaauggucucaugcacuggcaaagacugcuucuucauucccgccaacacagcgguccccauuguggaccgcuacgaauacagcucgaugaacaaaaucggacgggcccucacgggagagaugauaaaagaaaucugccuaccgcucaaaaucgaccgucucgggcaaauuauagaaaucagcaccuucuga

SEQ ID NO: 6892 - RNA, 4506 nt, Artificial Sequence
  Cas9 variant
augaagaaaauccuagggcucgaccucgggacaaauaguaucggaugggcgguuauuaacaaggccgagaacgaaggcaaagacguacuaugugggauagaggccgcaggcucacguaucaucccaauggacgcuacgaucaugggcgauuucgaaaaaggcaauagcguuucacagacaaaggaccgcagggaacaccggucgacccgcagacuauacgagcgggguaaacuucgccgagagcgacuaaaccgcgugcuauccgugaugggcuuccuucccgaccacuacgucucgcagcuagaccgauauggaaaguuccuuagcaacaccgagcccaagcucgcaugggucagaaacgccgacugcaaguaccauuuccuuuuuauggacucuuucagcgagaugcuacaagaguucaaaacaaacucaccccaauauaucucggaagaaucgaaaguuccauacgacuggacacuauacuaccuccgcaagaaggcccucacgcacaaagucaccaaagaagaacucgcguggauccuacuaaacuucaaccaaaaacgaggcuacuuccagcuaagagacgaaagcgaagaagaaaagaaacccuccaaaauccgccaauacuucgagcaucaaaaaguggucgacaucaucgauacaaacgaagucuacaaagggcuaaaagugcuaauuguaauacucgcgaacggaaucucgggcaagaucuucaagaaagaaauccccgacuggaucgguguggagaaagacauaauagucaaaguagacaucgacaaggacgggaaggacaaauucaacgaggacggcagucugaguugcagguucaacaucccaacagaagccgaaugggauacagagugggagcucauaaaacagaaaacacaaaaugaccucgacgcaagcggcaaaaccgucggggaguacauauucgacacccugcuaagaaaccccgagcagaaaauccgaggcaaacucgugcgcacaaucgagcgacgauacuacaaagaagaaauaaaugccauccuaaagaagcagaaggaguuccacccagaacucucugaccgagcucuuuacgaaaaaugcguagaggaacuauaccccaacaaccccgcccaccggaacaugaugcucauacacgaccuauccuauuuccuagucaacgacauauuguucuaccagaggccccuuaagagcaaaaagagccugaucgaugaaugcccauacgaaagccaccucuacaucgacaagaaauccggggaacggaaaccaguggcggucaaaugcaucgcaaaaucgcacccccuauaucaagaauuucgacuguggcaauucauaucaaaccucaggaucuaccagaaaacgaaagaaguagggaacagccucaaaguggauguggaugucaccaacgaguuccucaaaggcgaaaacgacuacguagaacuauucgacugguugaacaccaagaaagaaaucaaacaagaggacuuccuaaaauauaagcccuucggcuucaccaaaggcaacauaaacaacuacagauggaauuacguagaagacaaaaucuacccgugcaacaaaacccacuauacaauacucaaaggccucgaaaaggcagauaucacguucgacgaguucauaagccacgauucccucgccgaagagaaccuauggcacauucuguacagcguaucaucaaaagaggaguugaaacaugcccucgaaucauucgcagacaaaaggggccucuccaucaaguucguggacgcguuuaucaacaccccagcauuugagaaaagcuacggggcuuauagcgccaaggcgaucaagaaacuccucccacucaugcgcaugggaaaauacuggaaagaagaaaacauuugcgacagcacacgcgagcgcaucgacaaaaucauaacaggcgaauacgacgaaaauauccgcgaccgcgucagagaaaaguccauaaaccuaacagacaucacccuauuccgagggcucccgcucuggcucgcgugcuauguagucuacgaucgccacucugaagcgggaaacacagagagguggacaucaccguccgacauagaccacuacauacggaaauucaaacaacacucacucagaaacccaaucgucgagcaaaucguccuggaaacgcuuaggacaguacgagacguuuggacagaagucggcggaauagacgagauccacgucgaacuaggccgggagaugaagaacccuagugauaagcgacggaaaaugagccuucaaaugcaagaaaaugaaaacacaaaccuucgaauaaaagcacuccuugccgaguucaucaacccggaauugggcauugaaaacguccgaccguacuccccgagccagcaggaccuccuaagacuguaugaagaaggagccuggaacucuccggagaucgaugaaaagcagguugacgaaauguuggccaucuugaagaaauucaacgaaacugacuccagcaaaagacccacuaaaucagaaauaaaacgcuaccgccuauggcucgagcaaaaguacagaagucccuacaccgguaccccaauaccacugagcaagcuguucaccacggccuacgaaaucgaacacguaaucccaagaagccgguucuucgacgauucccuaaccaauaagguaaucugcgagagcgaaguuaacaaacucaaaggaaauaugcuaggguacgaguucauaaaaucccacuauggcgaaaaaguacaacuguccagcggcuccgaaguccaaauauuuucgguaaacgacuacgaaaaguucgucaaagaccacuacucuaagaacaaggccaaaaugaaaaagcuacucauggacgacaucccagagaaauuuacagagcgccaaaugaacgacucccgauacauaagccgucucauuguaucgcugcuguccaacaucguaagagagaaaggggaacaggaauccauaagcaagaauguccucgugugcaccggaggcgugacggaccgacugaaaaacgacuggggagucaacgacgucuggaacaagaucauccuaccccgcuucaagcgaaugaaugagauaaccgacucgacagacuacaccagcguaaauaccuccggacacauaauuccugcaaugccacuccaucuccaaaaaggcuucaacaagaaacggaucgaccacagacaccacgccauggacgcgaucgugauagcgugcgcggggagaaacaucguaaacuaccucaacaaccaaucauccaaauccgacguaagucgccacgaccuacgaaaccuccucugcgaaaaagacaaauccgaccgaaaagaacuuauaauaaagcccugggacacauucacgcaggacguauacaguguccuaagcaguaucaucguaucgaucaagcagaaccugagaguuauuaacaaaacaaagaacauauaccaacgcaaagaagauggcaaagucauaaucagcaaacaagaaaacaacaucaacuggugggcgauacgcaaaccguugcauaaagaaaccgugagcggagagguaaaccuacggaaggagaccacgauuucgcucaaggaggccauagacaacccugccaggauuauagauaaagacuucaagaagaagcuaagagagcucauccuaaugggcuacaacgagaaacucauaaagaaauacuucuaugacaacaacgaaagcuggcaagacgucaaccucaagaaaauccccgccuacuacuucacuaaagacaccaaugaccgcuauuucgccagccgaucgcuucuagacgagaacuucgacaaaaagaaaauagagaacaaagucacagacacaggcauccgaaccauacuacugcgacaccucgaagucgaagggggagacuccaagguagccuuuucucccgagggacucgaacgcaugaacaagaacaucgaaauacuaaaugggggcaagaaacacaaacccaucuauaagguacgagaauacgaaaaagcagagaaauucgcggucggaaugcgcgguaauaaagccuccaaauucgucgaagcagccaaaggaacaaaccuauucuucgcaguauacgacaauggaaagaaacgcaguuucgccacaguaccacucaacgaaguaauccgauugcaaaaggagggacuacccagcgcccccgccaacgaagagggucuacugccgaaguucguauuauccccgaacgaccucguauacguacccacagaagacgaacugagaucgggccuacugcccgagaaccccgcaccagagcgaauauacaaaaugguuaguugcaccggauaucaaugcuuuuucauccauuucagcguaagcgggguucuaugugacaaaaaggaauuuagcucauuaaacaagauggaacgggccauuucaggugaaaugauaaaggaaauauguaucccccucaaagucaacagacuuggcaaaauaauguauaaccuuuga

SEQ ID NO: 6893 - RNA, 4506 nt, Artificial Sequence
  Cas9 variant
augaaaacaauccucgggcuggaccucgguaccaacucaauaggaugggccaagauaagcaucgacgacaacggcaacuaucuccgagacauccagcuaggcagccgaaucaucccgaugucacaggauguauuaggcaaauuugacaacggcgugaccgagagccaaacugccguccgcaccggcuucagaggacuacgaagaauccgcgaacgaucccuccucaggcgcgaacgucuccaccggguucuacacguuaugggguuccucccaccccauuacgauucagccauaggguggaacaaagaagaaccauccacauacggcaaguuccucaaccacggcgagccaaaacucgccugggaaagacaaggcgacggcagcaugagguuccuguucauggacucauuccauaaaaugauggaggauuucgcgccccaccaaccggcccuaguagcggacggacgcaagauaccauuagacuggacacucuacuaucuaagaaagaaggcgcugacgcaacccauaaagaaagaagaacuagcguggauccuucugaacuuuaaccagaaacgcggguacuaccagcuuaggggagaggaagaagaagaaaacccaaccaaaagagaagaauaucacgaacucaaaguaguauccgucgaagcggccgaagaagggaaaggcgggaacacaugguacaacgucaagcuagaaaacggauggauauaccaccgaccauccaaaauagaccucucagacuggguagggaaaacgaagcaguucauagugacgauggaauacgaagcagacggcauaacucuaaagaaaaacaaagaaggcgaagucaaacggaguuuccguguccccgacgaagacgacuggggccugcgcaagaaacgaaccgaaucgcaacucgaagccuccggcaaaacugugggcgcauucauauacgaccaccuacucgcagaaccugccgacaaaauccggggcaacuucauccgaacgauugagcggaaauauuacaaacaggaacucgcagacauucuccgggaacaguccaaauaccacgaggaacuccaaagcaagaaaauacucgcugacugugcggaggaacucuaccgcuccaaccaaccacaccgagacucccuccucaagaaagacauggucuaucuucuccucacagaucucaucuucuaccagcggccccucaaauccaaaaagucguugaucgccaacugcccauacgaauacuaugaguacguagauaaagaaacgggcgaaaucaaacgacagggaaucaagugcguagcuaaaagcaacccauacuaccaagaguuccgccuauggcaauuuguacuaaacuugcggcuauacgacagaaccgaagacaaggaaguaacugccgaauaccucccaucgaaggaggacuacgcccgccuguucgucuacuuaaacgaccgcaaagagauaaaccaagaaacacuccuaaaggacuucuucaaacucaagaaagucaagcaacgauccgagaaagaauuucccguucgguggaauuacauugaggauaaagagaagaaauaucccugcaacgagacgcggcacgaacuccucauggcacucgacagggcagggauggaaagaagcuggcuggacgauacagcccgacaauaccgacucuggcaccuccucuauuccauugaaguaaaagacgaagcugaacgcgcgcuccgcaaacuuaaggacgacgacgaguuugucagcgccuuccucaaagugaagccguucaaaaaggacuacggggcauacagcgagaaggcggugaagaaacuacucgccguaaugagaaugggcucgcacuggugcgaggacgacauaugcaaagaaaccaaagagagaauagaacauauccuacaaggcgacguagaggagaaaaucaaagaacggaugaaccacacggcauacucgcuuggagaacucagcgacuuccagggccuccccgaauggcucgcgugcuacguagucuaugggcgacacagcgaagccacugacauaaaacacuggaaaacuccggagucacucauggcauacaucaacggguucaaacaacacucgcuacgaaacccaauagucgaacagugcauccuagagacccugagaaccguccacgacauauggaaagaagccggccacaucgacgaaauccacguggaacucggaagaagcaugaaaucgaccucggaccaacgagcgcggaugaccgagaacauccugcgcaacgagaacaccaaucuaagaauaaaaagccugcuaauggagcucaagaacgacgccgacauaaaggacguucggccguacagccccaugcaacaagaaauccuaaggaucuacgaagaaggcgcccuucaggaacucacaaaggaggacaacgauuacgaagaaauauucaaaaucucaaagaucccucagccauccgcgaaagagcuccucaaauacaaacuaugguuagaacaaaaguaccgcucuccauacacagggaaaccgauuucccuaagcaaacuauucacgagcgccuaccaaaucgaacacauaaucccacagucgagguacuucgacgacucauucaacaacaaggugaucugugaaagcgaagugaacgcgcuuaagagcaauaugcuaggauacgaguucaucaagaaccauggcggggagauaguucacugcacccuacuaggggacgucaaaguucaaaacgaaagcgaauacaaggcuuucgucaccgaacacuacgcaaauaacaaauacaagaaagagaaacuacuaauggaagacaucccccaagacuuccuuaaccgacaccuaaaugacuccagauacauaucaaaaguaguuaaaacccuacucagcaacaucguccggacggaagacgaaauggaaaccacaagcaaauucguggucucauguaccgggggcauaacagaccgucugaaaaaggacuggggucuaaacgacguauggaacuccauaguuuacucccgcuucgaacgacuaaacgaacuaacgaaaucggaugccuucggccgaugggaaaacaaagagggcaaaagagucuuccaaacguccgucccuuuagagcuacaacgaggguucaacaagaaaagaauagaccaccggcaccacgccauggacgcccuaguuauagccugcgcuagccgcaacauaaucaacuacuuaaacaacgaaagcgcgaacagcccuaagaaacgagaggaucuccgccaacagcucugcgauaaaaaccgaauaaucagaaaaccuugggaguccuucacacaggacgcccgugcagcgcuagaagaugucgucgugucauuuaaaaacuaugucagggugauuaacaaaacaaccaacuauuacgaacgauacggggccgauggagagaaaacgaucgccaagcagaagaacagcgaaaugugggcagugagaaaaccaaugcacgaagcuaaauacuacgggcgggucaaccugcagagaaaaacggaaguaagacucaaggccgcguuagaggacaucccgagcauuugcaacaaggaauuacgugacuauaucaaucgacucgucaaaucggggcuaaacgcgagacagcuccucgcccacuucaaaagcacagacuacugcuggaacaaacaaaacguagacaaaguugaaguauggcgcuucagcgaugaaaaagagccauuagucgccaucagagaaagccuugauaccuccuucgaugccaaacggauagacacaaucacggacacaggcauucagaaaauacuacuaaacuaccuagaagccaagggcggugacccggcaaucgccuuuacaccagaaggaaucgcggaaaugaaccaaaacauggcccucuacaacaacggcaagaugcaccaaccaauacuccgaguuaggcucagcaagaaaagaggcaaaaaguaccaagugggccagaccggcugcaaagccaagcaguucgucauaagugagagcggcacaaaccucuacuucgcgauuuacgaagacgaagaccguaaccggaccuauaacaccaucccacucaacgaaguagcagaaaggcuaaaacaaggacugagcccaguccccgagaagaaugaaaaagaagucccccucaaauucuaccuuucccccaacgaccuaguguauguucccacggaagaggaaauccucaugaaagaauguaaguuaaacaaaaauagaauauacaaguucauugacagcagcggaacuacagcaaauuucguaccacaccgcagcgccagucuaaucuacaacguagacaagaaacuggccgaagcauucuguaacgaugaaauaauccagaacgaauacgggguaggauccccacagagcaaaaaccagaaagcacuaacgggggaaaugauaaaggcaguuuguuggaaguuagaggucgauagacucggcaauaucauacgagucauaaaguga

SEQ ID NO: 6894 - RNA, 4515 nt, Artificial Sequence
  Cas9 variant
augaaaaauauugucggccuagaccuaggaaccaacagcauaggcugggcgguagucaauggaaacauaaacgacgacggcagcgagcagcugguuaaaauccaagcguccggcagccguauaaucccuauggacgccgcuaugaucggggacuucaacaaagggaacagcaucucccagaccgccgaacgcacccgacuacgcggcauccgaagacucucagaacgauaccuauuacggcgggaacggcuccaccggauccucgacauccuaggcuuccuaccgucacacuucgcccgggaccuagaccgcuacggcaagaucgucaaggacaaggagccaaaacuagcauggcgcaaaaacgaagccggacaauucgaauuuaucuuccaaaacuccuucaaggaaaugcuagaggacuucaagcucaaccauccaaaccucauaacggacgacaaaaaggucccuuacgacuggacaaucuacuaccuacgaaagaaaggacuaaccucaaagauaagcaaagaagaacuugcguggauauugcucaacuucaaccaaaagcgaggcuacuaccagcuuagaggggaagaagaggaagaaaacaaaaacaaacaagucgaauuuuacgcacuaaaggucaucgccguugaagacagcggagagaagaaaggcaaagauacaugguacaacguacaccuagaaaacggauggauuuaccggagaaccagcaauaugccacuugacuggguagguaaaaccaaagaguucauagucaccacugaccuggaaaaagacggcaccccuaaaaaggacaaagaaggaaauaucaagcgcucauuuagagcaccuaaagaagacgacuggucacuggucaaaaagaaaacugaagcagacauagaucagacacacaaaaccguaggcacauauauauacgacacccugcuaggcaacccaucacagaaaauccggggacgccucguacgcaccaucgagcggaaguacuauaaagaggaacugaaacucauccuagacaaacaaaaggaguuccaccccgaacuacaagaccgcgcgcucuacgcugcgugcguagaggaacuguacacaauuaacgaggcacaucgcaacaauaucggcaaucgagacuucacguaccucuuccucgaggacauacucuucuaccagcgaccacugaaaucaaagaaaagucuaaucgauaacugcccuuaugaagaaaaccauugccucgacaaggagacgggugagaucaaauucuucccagucaaaugcauagccaagucucacccucucuuccaagaguucagacuguggcaguucauugugaaccuccggauuuacaggaagggauuagcccaagacguagauguuacgaacgaacuacuuaagaccgaggaggacuacgucgcacuguucgacuggcucaauggcaagaaagaaaucgaccaaaaagccuuccuuaaauaucccccuuucggccucaagaaagaggucgaaaacuaccgguggaacuacguacaagacaaaaguuacccaugcaacgaaacgcguagccucaugcucgcccgacuagaaaaaugcgacaucucaauagaguuccucaccaaagaaaacgaagaagcacucuggcacauucuuuacaguguugaggacaaaaacgaaaucgucaaagcccuacaaaaauucgcggauaagcauaaccuuaacgcuagcuucguugacguguuccagaaguucccgagcuucaagaaagaguacgguaguuacuccgcaaaagccaucaagaaacuucucccacugaugagaaugggcaaauauugguccgaagacagcaucgacaaaggcacaagggagcgcauggacaaaauaaucaccggagaauaugacgagaaaauagaaaaccgaguucgugaaaaagcaauacaccucgcagacauuuccgaguucaagggacuaccacuauggcugguauguuacaucguauacggaagacacucagaauccaaagaaaucgcuaaaugggaauccccagccgacauagacucguaccucaagagcuucaagcaacacagccuaagaaaccccaucguugagcagauaauuauagagacacuucgcguuguccgagacauuuggaaacaggugggcaacauagacgaaauccacguagagcuagggcgggaaaugaaaaacccggccgacaaacgaagaaagaugacccagcagauuucugaaaacgagaacacaaaccuacggaucaaguaccuacucaccgaguuccuuaacccggaauacgaagucgaaaacguccgaccauacucacccagccaacaggauauacuaaggauuuacgaggaaggaguccugaacucaguguccaaccuccccgaggagaucucagacauacucaagaaauucacggagacggaccucaagaaacgccccagccggagcgaaguacuucgcuacaaacucuggcucgaacagaaauaucgcagcccuuacacgggcgaagucauaccacugggcaaauuauucacgccggcauacgagaucgaacacgucaucccccagagcagauacuuugacgacagcuucucuaacaaaguuaucugcgaagcggaggucaacaagcuaaaaucaaaccuccuagggcacgaguucaucgucaagcaccacggcgaaauagucgagcuccccuucggaaagaagguaaagauuuucacagucgacgaguacgagcaguucgucaaagacaacuacucccgcacccgagggaaaaugaagaaacuccuaguagacgacaucccagaagaguucgucgcucgacaguugaacgacagccgauacauaagcaaagucgucaaaucacuccuaucaaacaucgugcgggaaaaaggcgaggaagaggcaaucagcaagaacgucauuccaugcacaggaggagucacggacagacucaagaaggacuggggugucaacgacgucuggaauaaaauaauccucccccgauuucaacgucucaaugaacuaaccgggaccaacaaauucacuacaaugagccucaauaaccacgaaauacccgccaugccccuggaacuacaaaaaggcuucaacaaaaagcgcauagaccaccggcaucaugcaauggacgcaauaauaaucgcgugugcuaauaggaacauaauaaacuaccuaaacaacgagucagcuacggccaaggcggagcugucacgcuaugaucuccagcgccugcuaugugacaaggccaagacagacgacaacggaaacuauaaaugggucauccgcaagccuugggcuucauucacccaagacguacacggcguccucgaagauaucaucgucagcuucaaacaaaaccugcgugucaucaacaaagcaacaaaucacuuucuccacuacaacgaggaagggaagaaaauuuucgugaaacaagaaaagggagacagcugggcaauacgcaagucaaugcacaaggacacgguuuuuggggaggugaaccuccgcaggauaaaaaccgucgcgcuaaacgaggcaaugaaaaacccccagagcaucguagucaaagacuucaagcgcaaacuccucgagcuccuaaaccugggcuucgacgccaaacgcauaaagaaguacuucgaagacaaccgggaaaccugguccgacauaaaccucaguaagauuaccguauauuauuucagcaaagacaccaaggacagauucuucgcgacuagaaagccccuggacacaaguuucgaucgaaagaaaaucgaaaacaacauaacagacacaggaauacagaaaauacuccugcgccaccuggaacuuaaagacaauaaccccgacaucgccuuuagccccgacggcaucgacgaaaugaaccguaacaucauccaacucaacaacggcaaauaccaccaaccaaucauaaaagucagaugguaugagcaagccgacaaauucgcaguuggccaaacgggaaacaaauccucaaaauucguagaggcagccaagggaacgaaccucuucuucgcagucuaugagucaaacauccuagacgaaaagacaaacacgauaaucaagaagcgaaauuacgccacgaucccccuaaacguagccaucgaaaggcaaaagcaaggacugagcgucgcacccgaagaggaaaacggcaacgacccaauauucguacuuagccccaacgacuuggucuaccugccaacaacggacgagcucgcgaacgggguaguggcgcagccgcucgacaaagagcggaucuacaaaauggucucaugcaccggcaacgaaggacauuucauacccgcccggaucgcaaacccaauacuccagacuauagaacuaggguccaauaacaaggcccagaaagccuggacggaugagaugauaaaggagaucugcaugcccaucaaagucgaccgccuaggaaacauauuggaauccucuagccuucacaagaaauga

SEQ ID NO: 6895 - RNA, 4515 nt, Artificial Sequence
  Cas9 variant
augaaaaacauaguuggcuuggaucucgggaccaacagcaucgggugggcagucgugaauggcuccguaaacgacgacggaucagaacagcucguaaaaauccaagcaucagggucccgcaucauccccauggacgccgccaugauaggggacuucaacaaaggaaacucgaucagccaaacggccgaacgcacccgacuccgcggggugcggcggcucagcgagcgguaccucuuacggagagaacggcuacaucggauccucgacauuuuagguuuucuacccuuccacuuugcacaggacuuagaccggcacggcaagaucguaaaagguaaggagccgaaauuggcauggcgcaaaaacgaagccggccaguucgaguucaucuuucaggauagcuucaaagaaaugcuggaagacuucaaacucaacuacccgaaccuaaucacagacgacaagaaaguacccuacgacuggaccaucuacuaucuucgaaagaaaggauugacgucaaaaauaagcaaagaagaacuagccuggauacuccuuaacuucaaucagaaacgagguuacuaccaacuccguggcgaagaggaggaagaaaacaaggauaaacuugucgaguucuacgcccugaaagucguagccgucgaggacucgggagaaaagaaagggaaagauauuugguacaacguccaccuggaaaauggcuggguuuaccguagaaccagcaacaugagccuagacugggucggcaaaacaaaagaguucauagucaccacagaccuagaaaaagacggcaccccgaagaaagacaaagaagguaauguaaaacgcuccuuccgggccccuaaagaagacgauuggagccuugucaaaaagaaaacggaagcagacauagaucaaacccacaaaaccguaggugcauacauauacgacacccuccugggaaaccccucccagaaaauacguggccgacucguccguacuauagagcgcaaguacuacaaagaagaacucaagcuaauacuugaaaaacaaaaagaguuccaccuagaacuucaagaccgcgcccuauacgccgccugcaucgaggaacuguaccccaucaacgaggcacacaggaacaauguaggcaaccgcgacuucacguaccuguuucucgaagacauacucuucuaccaaaggccacucaaauccaaaaagagccuaaucgacaacugcccuuacgaagaaaaccaaggcuuagacaaagagacgggggaaauaaagagcuuccccguuaaaugcaucgccaaaucccacccccucuuccaggaguuccgccucuggcaauucaucauuaaccuacgcaucuaccgcaaagaccucgcacaagacguagacguaacaaacgaacuucugaaaacugaagaagauuacguagcccucuucgacuggcuaaacgguaagaaagaaauagaccaaaaggcuuuccuaaaguaccccgucuucgggcugaagaaagaaaucgaaaacuacagauggaacuacguacaagauaaaccguacccaugcaacgagacccgcucccuaaugcucgcacgacuggaaaaaugcgacaucagcauagaguuccucacuaaggaaaaugaagaagcccuauggcauauccuuuacucagucgaggacaaaaacgaaaucgugaaagcacugcaaaaauucgcagacaagcacgaucugaacgccucauucgucgacgucuuccagaaguuucccccauucaagaaagaauacggcucauacagcgcuaaagcgauaaagaaacuacugccccuaaugcgcaugggcaaauauugguccgaaaacagcaucgacaaaggcaccagagaaaggauagacaaaauaauaaccggcgaguacgaugagaaaaucgaaaaucggguacgggagaaggcuauacaccucgcggacgucuccgacuuuaaagggcucccacuauggcuuguaugcuacauaguauacggucgccacagcgaggcuaaggaaauaauccaauggaagucgccugccgacaucgacucauaucugcgcucguucaaacagcacucguuaagaaacccaaucgucgagcaaauaaucaucgagacacuccgcguuguccgagacaucuggaagcaaguagggaacaucgacgagauccacgucgagcuaggucgcgaaaugaagaacccggcagacaaacgcaaaaagaugacacaacaaaugagcgaaaacgagaacacgaaucuccgaaucaaguaccuacucacagaguuccucaauccagaguacgagguugaaaacguccgcccguacagcccaagccaacaggacauccuucgaaucuacgaagaggguguccugaacuccguaagcgaccugccagaagaaauaucggacauccucaagaaauucacggaaacggaucuaaagaaacgucccagccgauccgagguacuaagauacaaacuauggcuggaacaaaaauacagaagcccguacacgggcgaagucaucccgcucgggaaacucuucacaccagccuacgaaaucgaacacguaauaccgcaaagcugcuacuuugacgacagcuucucgaacaaaguaaucugcgaagcagaagucaacaaacucaaauccaaccuacucggucaugaguuuauugugaaacaccacggcgaaaucguagaacugccguucggcaagaaagucaggaucuucaccguggacgaguaugagcaauucguuaaagacaacuacucccguacgcgcagcaaaaugaagaagcugcucauggacgacauucccgaagaguucgucaccagacaacucaaugacagccgauacaucucaaagguggucaagagccuacuuucuaauaucguacgggaaaaaggcgaagaggaggccauuuccaaaaacgugauccccugcacagggggcguaaccgaccggcucaagaaagacugggggauaaacgaagucuggaacaaaauaauacugccacgauuccaacgucucaacgagcugacgggaaccaacaaauuuacaacgaagaacgucggcauccaggagauccccacaaugccacucgagcuccagaaagguuucaacaagaagcgaaucgaccaucgacaccacgcaauggaugcaaucaucaucgccugcgcaaaccgcaacauaauaaauuaccugaacaacgaaagcgcgaccgcaaaggcggaacuguccagauacgaccuacagaaaaugcuaugcgacaaggcgaagacggacaacaacggcaacuacaaaugggugauacgcaaacccugggcaucguucacacaagacacguacuuagcacucgaaaacaucaucgucagcuuuaagcaaaaccugagggugaucaacaaagcgacgaaccgcuuucuccacuacaaugaagagggcaagaaaauauucgugaagcaaggcaagggcgacaacugggcaauccgaaaauccaugcacaaagacaccgucuucggagaggucaaccuccgacgaaucaaaacaguagcccucaacgaggcgaugaaaaacccccagagcauagucguaaaggacuucaagcggaaacuacuggaacucuggaaccucggguucgacgccaaaaggaucaagaaauacuuugaagauaaccgcgaaacauggucagacauuaaccucagcaaaaucgaaguguauuacuucuccaaggacaccaaggaccgguucuuugcuacucgaaagccccucgacacgucauucgaccggaagaaaauagagaauaauauaacggacacaggcauacaaaagaucuugcugcggcaucuagaacuaaaagauaacaacccagauaucgccuucaguccagacgggauagacgagaugaaccgcaacauaauccaacucaacaacggcaaauaccaccagccaauaaucaagauccgaugguaugaacaagcggauaaauucgcggucggccagacgggcaacaaauccucgaaauuugucgaagcagccaaaggcaccaacuuauucuuugccguauacgagaguaauauuuuggacaagaaaacgaacacaaucaucaagaaacgcaauuacgcuaccaucccacugaacguagcaaucgagcggcagaaacaagggcugcccgucgcacccgaagacgagaacggcaaugacccgauuuuugugcuuucacccaacgaccuagucuaucugccaaccgacgacgagcuagccaacgggauaaucgcccaaccgcucgaccgaggaaggaucuacaaaaugguaucauccucaggcgaacaaugcuucuucauuaagcacauagucgcgaacguccuaguugauaaauucgaguucucaccccuaaacaaaauggaacgcgcccucacuggagaaaugauaaaaaugaucuguauacccauaaaaguggaccgacucggaaacguacucgaaucgucaagcucauacaagaaauga

SEQ ID NO: 6896 - RNA, 4515 nt, Artificial Sequence
  Cas9 variant
augaaaaacauaguaggccuagaccuaggaacaaacuccaucggcugggccgucgucaacggcucaguaaacgacgacggaagcgagcagcucgucaagauccaggcuuccgggagcagaaucauccccauggacgcagcgaugauuggagacuucaauaaaggaaauuccauaucacaaacagcugaacgaacaagacugcgaggcguccgcagauugucagagcgcuaccuccuccggcgcgagcgacugcaccgaauacucgacauacuaggauuccugcccuuccacuucgcccaagacuuagacagacacgggaaaauaguaaaagggaaagaaccuaagcuggcguggcgcaagaacgaagcagggcaauucgaguucaucuuucaagacaguuucaaagaaaugcuggaggacuucaaacuaaaucacccgaacuugaucaccgaugacaaaaagguuccguacgauuggacaaucuauuaucuaaggaagaaaggccuaacgagcaagauaucgaaagaggaacuagcauggauccuacuaaacuucaaucagaagcgaggauauuaccaacucagaggagaggaagaagaagagaacaagaacaagcuaguugaguucuacgcacugaaagucgucgcaguagaagacuccggcgagaaaaagggaaaggacauaugguauaacguccaccuagaaaacggauggguauacagacgcacauccaacaugccacucgauugggugggcaagaccaaagaguucauugucacaacagaccuagagaaagacggcacccccaagaaagacaaagaaggcaacgugaaacgcagcuuccgagccccaaaggaggacgacuggucgcugguaaagaagaaaacugaagcugacauagaucagacgcacaagacgguaggcgcauacaucuacgacacccuccucggcaacccuagccagaagauacgaggccgucugguaagaacaaucgaacggaaguacuacaaggaggaauuaaagcaaauacuagaaaagcaaaaagaguuccaccuagaacuccaagaccgggcccuauacgcagccugcauugaagaacucuaccccaucaaugaagcccacagaaacaacguaggaaacagggacuucaccuaccucuuccuagaagacauccuguucuaccaacgcccccucaaaaguaagaaaucccucaucgacaacugcccguacgaggaaaaccaagggcuagacaaagaaacgggggaaaucaaaucauucccaguaaaaugcaucgcgaaaagccacccucuauuucaggaguuccgacuauggcaguucauaaucaaccuacgaaucuaccgcaaggaccucgcccaggacguagacguaaccaacgaacuccugaagacagaagaagacuacguggcacuauucgacuggcucaacgggaagaaagaaaucgaccagaaggccuuccucaaauacccaguguuccgacuaaagaaggaaaucgaaaacuaccgguggaacuacguccaggacaagcccuacccgugcaacgagacucgaucccuaauguuagcccgacuagaaaagugugauauaaguaucgaguucuuaacaaaagaaaacgaagaagcacucuggcacauucuauacuccguagaggacaaaaaugaaauaguuaaagcacuacaaaaauucgcagacaaacacgaccuaaacgccuccuuuguggacguguuccagaaauuucccccauucaagaaagaguaugggagcuacuccgccaaagccauaaagaaauuacugccgcuaaugcgcaugggcaaauacuggagcgaaaacucgaucgacaagggaacgagggcucgcaucgacaaaaucaucaccggagaauacgacgaaaagauugaaaaccgcguucgcgaaaaagcuauacaucuggcagacgucagugacuucaagggccuaccguuauggcucguaugcuacauaguauacggaagacacucagaagccaaagaaaucauccaguggaaauccccggccgauauagauucauaccuacgcagcuucaaacaacacucacuccgcaacccuauaguagaacagauuaucauagaaacacuacgcguggugcgcgacaucuggaagcaaguggguaacaucgacgaaauacauguggaacugggccgggagaugaagaaccccgcagacaaacguaagaaaaugacccaacaaauguccgaaaacgaaaacaccaaccugcgcauaaaauacuuauuaaccgaguuccuuaacccagaauacgaagucgaaaacguacgaccauacucacccucccaacaagacauacuacgaaucuacgaagaaggaguccugaacucggucagcgaccuccccgaagagaucagcgauauccuuaagaaauucacagagaccgaccucaagaaacgaccaucgcgaagcgaaauccuacgcuacaaacuuuggcucgaacaaaaauaccgcagccccuacacgggcgaaguaaucccccucgguaaacucuuuacaccagcauacgagaucgagcacgucauaccgcaaucaugcuacuucgacgacucauucucaaacaaagucauaugcgaggccgaagugaacaaacucaaaagcaaccuacugggacaugaauuuaucgugaaacaccacggggagauaguugaacucccuuucggcaagaaaguccgcaucuucacagucgacgaguacgaacaauucgucaaagacaacuacucacggaccagauccaaaaugaagaaacuucuaauggacgacauccccgaagaguucguaacccgacagcuuaacgacagccguuacaucaguaaagucgucaagagucuacuaagcaacaucguccgagaaaaaggcgaagaagaggccaucagcaagaacguaauaccgugcaccgggggagucaccgaccgccuuaaaaaggacugggguaucaaugaggucuggaacaaaaucaucuuaccacgguuccagcgacuaaaugagcucacgggcaccaacaaauucacuaccaagaaugugggacugcaggaaauccccacuaugccucuugaacuccaaaaaggcuucaauaagaaacgcaucgaccaccgacaccacgcgauggacgccaucaucauagccugcgccaaccgaaacaucauuaauuaccuaaauaacgaauccgcaacugcaaaagcggaacuaagccgcuacgaccuucagaaaaugcuuugcgacaaagcuaaaaccgacaacaacggcaauuauaaauggguaauccgcaagcccugggccagcuucacacaagacacuuacuuggcacuggaaaacauaaucgucagcuucaaacaaaaucuuagaguuauaaacaaggccaccaaccgguuccuacacuacaacgaggaaggaaagaaaaucuucgucaaacaaggcaaaggggacaacugggcaauacgcaaaagcaugcacaaggacacgguauucggcgagguaaaccucaggcgcaucaaaacagucgcccucaacgaggcuaugaagaauccgcaaucgauaguggugaaagauuucaagcgaaaacugcuagagcuguggaaccugggauucgaugccaagcgcauaaagaaguacuucgaagacaaccgcgaaacauggagugacaucaauuugagcaagauugagguauacuacuucuccaaggauaccaaggacagguucuucgcgacgcgaaaaccgcucgauacaucuuucgaccggaagaaaaucgaaaacaacaucacggacaccggaauccagaaaauacuauuacgccaucuagaacugaaagacaacaacccggacauagcauucagcccggauggcauagaugagaugaacagaaauauaauccagcuuaacaacgggaaauaccaccaacccauaaucaaagugcgcugguaugagcaggcagacaaguucgcagucggccaaaccggaaauaaauucucaaaauuuguagaagccgcaaagggaaccaaccuauucuucgcaguguacgaaucgaacauccuugacaagaagacaaacaccaucaucaagaagcgaaacuacgccacgaucccgcucaacguugcaauagagcgacaaaaacagggccucccaguagccccagaagacgaaaacggaaacgaccccaucuucgugcuaagcccaaacgaccuaguauaccuacccaccgaugacgaauuagccaauggcauaaucgcucagccacuugaccguggccgaaucuacaaaauggucucgucguccggggaacagugcuucuucauaaaacacauagucgccaacgugcuaguagacaaguucgaguuuagcccccucaauaaaauggaacgcgccuuaaccggagagaugaucaagaugauuugcauaccaauaaaagucgaccgccuggggaacguccucgaguccagcaguagccacaagaaauga

SEQ ID NO: 6897 - RNA, 4515 nt, Artificial Sequence
  Cas9 variant
augaaacgaauccugggccucgaucucggcacaaacagcaucgggugggcccucauagaaaacgacuuuaaucguaaggaaggcaagauugaggcucugggaucgcgcauaauccccaugagccaagauauccucggcaaauucgacucuggcgucacagucucccaaacugcggcccgaacaaacuacagaggaauacgucgacucuaccagcgugacaaccugcgcagagaacgauuacaccgaguacucaacauucuaggguuucugcccaagcacuacgcagaaucuauugacuucgaagauagacuaggacaauuuaaaccagaaacagaagugaaacuuccauaucgaaaggacucugacgacaacuaccacuucaucuuccaggaauccuucaaugagauggucgaggaguuucaauucaaaaaccccagccuguucuacacgaaagcaaacggagaacaaucaaaaaucccguacgauuggaccuuguauuacuugcgcaagaaagcucucucgaaaaagauauccaaagaggaacuugcauggauacuccucaauuucaaccagaaaaggggauauuaccaacugcgcggcgaagaagaagcugauucuaaagacaagcucgaggaauaucaugcccugaaaguaucugacguacaagccacggaagacacaaacgccaagggcacaugguacaacguaauacucgaaaacggcuggauauaccgacgacagucaaaggacagucuguucgacuggaaaggaaaaacucgugaguucaucgucacgacuuccuuggaaaagggaggcgcggugaagauagacaaagagggcaacgaaaaacggucauuccgcgcaguggauagcgaaaaagauuggauagccauuaaaaagaagaccgaaaacgaccuugcaaacgccggcaccacgguaggagucuacauauacgaaacccuacuaagaaacccagaccagaaaauccgcggaaaacucauaaaaacgaucgaacgaaaauacuaccucgaggaacugaaggcaauccuggccaagcaaauccaagagcacgcugaacuucaaaaccgaucgcuauauaaggacuguaucgaagaacuauaccaaggcaaugaagcacacaaaaauaacauaaaagaaaacggcuucgacuaccuauuccucgaggacauaauauucuaucaacggccccuaaagagcaagaaaucgacgaucagcaacugcccauacgaaucacgcguauuuaucaaagacggcaagaaggaaauacaacccaucaaguguaucucgaagucaaacccaaucuaccaagaauuucgccuguggcaauucauacauaaccucaagauauacgaaaaagaagcaaucgacgacggaaaaacugucauaaacaaagacguaacaacagaguuccuaaacacacaagaggcguacgcggcacucuucgaguuccuuaacgauaaagcggaaaucagccagaacgcgcuccucaaguacuuuaaacuuaguaccaacacacaccgguggaacaacgucgaagacaagaaauacccaugcaacgaaacccgcucggaguucauaaagcgccugagcaaaauggacgguauugaccugggcaagacacuaagccccgcguucgaaaagucccuauggcacaucaucuacagcgugaaagacaagaaacaguacguacgggcccuagaaaccuucgcaaugaaaaacggguuggacauaaaccaguuucgcgaaaacuucgaaaaauucaaaccguacgacagcgcguacggcgcauauuccgaaaaagcccucaagaaagugcucccccuaauccgccgaggcaccuacuggaagaaagacgcaaucccggccgcugugcaagagaggaucgugaacaucaugaaacggauugagucugucgacuucaaucucgagaaaauugaaaacuucgccgacgacgacaucccaaagcagcuccuaaagaguuucgccaaaggcaaagauccaaugcaaggccugaacaccuaccaagcgugcuaugccgucuacaacaggcacuccgaagugagugacauccagcuguggaaaaguccagaagacauaaccaaauaccucgauucauucaaacaacacagccuacggaacccaaucguagaacaggugguuauggagacccuacgcguaguacgagacaucuggcaauacuacggcaacggcgccaaagacuucuuuucagagauccacguagagcugggccgcgaaaugaaaaacgacaaaaagacacgcgaacgaaucagcaagucgaucacggagaaugagaauaccaacgaaagaauaaagaacauccuaaaagagcucaugggcgacgaggcccuacaaggcgacauccgacccuacucaaaagggcaccaggacauccuaaagcuguacgaagaaggcguauucgccaacgccccggagacguacaaaaacauaaaaauagacgacaucgagaagauacgcaagaacaacuccccgagcaaaagcgacaucguaaaguacaagcucuggcucgagcagggcuacaucucccccuauacaggaagcccaaucccgcuaagccgucucuucaccacagacuaccaaauagaacacaucaucccacgaucccguuacuucgacgacagcaugggcaacaagaucauaugcgaaucugcaguaaacgaagaaaagacaaauaagaccgcauacgaguucaucaaagaaaaugccggacgcaucaucgaccuaggccaaggaaaacaagucccccucuucgaccucgaagccuacgaaagccacugccgcggcuacuucaaaggcaacacaaagaaacuaaaauuccuccucagugaggacaucccagagggcuucaucaaccgacaacugaaugacucacgauacaucucgaagguagucaccucgcuccuaagcaacgucgugcgcgaggaaggggaacaggaggcgaccucaaagaacuuagucccccuagucgggaccauuacgaguaaacuuaaaaaggacuggggccuagaagcuaucugggacgaccuaauugcgccaagguucgaacguaugaaccagcucacaaaaucaaccgacuuccggaaggaaguaauagacgggcacggcaauagauacuucauaaacacuguccccgacgacauaaagaaaggcuucuccaagaaacggaucgaccauaggcaccacgcguuagacgcccuaguaauagcauguaccacgaaagaccaugucaacuauaucacaucccucaacacccagcgcaauaacagaucucuuguuucaaaacuccgcaaaaucgaagagaagacaauaaaggacaagcgcacaggacaacccaaaaccauaaaaaucgcaaaggcuuaccacaaaccauggcccaacuucacaaaagaaaccuuugaaaaacucucgaaaacgguaguuagcuucaaacaaaaccaacgcauaauaaacaagacuaacaacaaaaccuggggcugggagaaaguggauggcgucaugaagaaaguacucaagaaacaagagaaaagaaacugggcaauucgcaaaccaauacacaaagaaaccuacuacggaaaagucaaaggcuucgacucacccaagggcaagauaacgacggccaccaggaaaucacuccgcgagaucacaaacgagcgacagcucaacacaaucacagauucuggcaucaagaaaauccuuaacaaccaccucaaaacauucauagacgaaucagguaaaauaaacuucgaacccgccuucaaccaagacggaaucgaccuccuaaacaagaacauacaacaacuaaacgagggcaaaaaccaccagccaauauacaaaguucgcauguacacccacaacacuauguucuccguaggcgacgaagggaacaaaucaacgaaauacgucauacccgagucgggaaccaaccuauucuucaacguuuauugggacgaagaaaacaacaaaagaaacuucgaaacugugccccuaaauagaguaauagcauuccagaaacaaacaucgcacauccccagaaaggaccggacggacguuccuauagacaacacgcuaggucgguuccuguucacccuaagccccgacgaccucguauaccucccaacugaugaggagagcgagaguuucacaaccuucgagauagacucccuaaacucaaaacagguggccaauauauauaaauucguggacggcagcggaacaacgggaaacuucguacccgcagaagcugcccgagucaucgccaacaucaaagacaagaaagugcgaagcaacuucugcaaaagaaacaaccucuccgacaaacaacucaucaaaaacgaauuuggacugggguccccacagcugaaaaaucaaaauagccucgacgggcggcaaauaaaguccauaugcuggaaacucgagaucaaccgccucggcaaaauaaucaaggugauaaaguga

SEQ ID NO: 6898 - RNA, 4515 nt, Artificial Sequence
  Cas9 variant
augaaaaagguccucggccuggauauaggaacgaacagugucgggugggcagucguuaaccaaaacgacaaaggcgaauuucucucgaucgagaaaaucggaucucgaauaauccccaugucccaagacguaauggacaaauuuggcgccggacagacagaaucuagcacagcacaacgcacacaauacaggggaguccgacgacuacgcgaacgcagccuucuaagacgcgagagacuccacagggugcuacacauccuccacuuccucccccaacacuacgacgcagcgauagguuggaacaagaaagaaaauaagacguaugggaaauuccucccgggcguugagguaaacaucccguggguagcgacagaccaaggccaccaauucauuuucauggacucguaugcggaaaugcucaaggaccucaaacaacaucaaccccaucucuucgagaaaagcuccacgccgguuccccucgacuggacuaucuacuaccuacggaaaaaggcccugacacaggccaucagcaaagaagaacucgcauggauucuccuaaacuucaaccagaaacgcggcuacuaucagcucagaggggaggaaguagaggauaacaccaaacgggaagaguucuacgcacucaaagugguuaaaguagaacucgacaaagacaacacauccgccaaaacaugguauaaagugcaccucgaaaacggauucaucuacccgugcccaagugacacgccaaucgauagcuggguagggauggucaaagauuuuauugucaccacaacacuggaaaaggacggaagcgaaaaacgaacagcagacggugagaucaaaagguccuuccgugcgcccaaggaggacgacuggacacuccucaaaaagaaaaccgaaagcgaauuagaaaagagcggcaagcaagugggagccuucauauacgauacccuacucagcaaucccgaccagaaaauaauaggaggucucaucaaaacgaucgaacgaaaguacuacaagaaggaacuggagcaaauacucgagacacaacaaaaauucauagcagaacuaagcgacaagaaauuauuccaggccugcgcggaagaacucuacccucuaaacgacucgcaccgugaaaauuugcuagaacgcgacuucaaacaucuguucguucaggacauaauauucuaccaccgaccauuaaagacaaagaaaucccucaucucgaacugcaccuacgaguaccgaaccuucuacaaaaacggagagaagcaaaucucgccaaucaaguguaucgccaaaagcaacccacucuuccaagaguuucgcguguggcaauucgugcagaaccuacgaauccugcaacgacagcgauccgaaggcgacagcaucaaauacaacguggacgucaccgccgaguuccuaaaagaugaaaacgauauagccaaccuauucacauggcucaacgaacggaagguaauaaaacaagaccagcuacucaaaagcuauuuuaagcucaaagucaacaaggaaaccaaagaacuagacuauagauggaauuacguggacgacaaaaacaaggaauacccuugcaaugccacccgaacccacauccucagcuuccuugaaaagugcaaagaagaaaagagaaucgaagacgaccgguucguauacucgcuguggcacuuguuguacucagucguugaacccaucgagcuccgaggggcccucgccaaauuugccgaaagagaacaccuacaccccucuuucguagacgucuuugcccaguucccgccccuagaaaaggaauacggguccuacuccgagaaggcgauaaagcggcuacucccacugaugcgaaugggcgacuacuggcacgaggacaaaaucgacguuaagacaaagcagcguauacaacgcauaauagacggggaagccgacgacgacauaacccaccggucgagggaaaaagucgaaaaccugcguuccauuacggacuuuaagggccucccacuauggaaagccggauacguaguguauaaccgccacuccgagagcggagaacucacaaaauggaaaacuccccaugaacucuccaacuacauccaaaacgaguucaaacaguauucgcuacguaaccccauuguggaacaaaucguccuagaaacacuccgaguaguccacgaccuuuggguaaaacacggagacuuuagcgaaauacaccuggagcuaggaagagacaucaaaaacagcucagacaagcgaaagcgcauggccgaacgucaacaggagaacgaaaacucaagacaacgcguccuagagauguuaauagaccucaagaaagaggcggcauucgcagaccucaaccccuacagcccaagccagcaagagaaacucaggaucguagaggacggaguacuuaggucaaacaucgaaauccccaaagacaucgagaaaauaacgaaaucagcgaaaccaaccucccgcgaacuuaccaaauaccggcucuggcucgaccaaaaauaucgaagcccauacaccggccaacccauaucacuugcacagcuauucacuagcaaguacgaaaucgaacacguaaucccccaagcuaaguacuuugacgacucauucaccaauaaagucaucugugaaagugaagugaacaaagaaaaaggaucaaugcucgcucaugaguucauccuaaagaacggugguucaacuguaaacguaggcggucgacagguccaaguucuaaagaacgacgcguacguggaacugauuaaccgccuauauggaaagaauaacccagugaaagcaaagaaacuacuugcagaagacauagacgaagucgucggggacuucucugagcggcagcuaaacgacacgcgauacaucucacgcgucgugcaaaaacuucuguccaacauaguacgugaggaagaugagcaagaaaguacaagcaaacacgucaucgggugcagcggccaagucaccacagcgcucaagaaggacuggggccugaaugauauauggaacaaaauaauccagccgcgcuucgagcgccucaacgagaugacagccacggaggacuacggcgucuggcaaagccccaaccacuuccaaauacgcguaccagaagaaauccaaaagggcuuuaccaagaaacggaucgaccaccgccaucaugcaauggaugcucuggucaucgcgugcgcaacccgcagucacaucaacuauauaucaaacagaucuggccaggacaggaaugccaaauucgaaaccacgcgaaccgaccugcgcuccaaacuaugcuauaaagaaaacagcuccggcaacaacuacaacuacauauuuaacaaacccugggacacuuucacgcaagacgcccaucgggcgcucgagaacauaguggucucacacaaacagaaccuacgcguccugacgaagacgaacaauuacacccaguucauaaacaaagacggcaagaaggaucugcaaaaacagguaaaaggagaccacuuugcaguucgaaaacccaugcaucaagaaaccaucuacggacgcguuagcauacgcagcauaaaagaaguagcgcucaagaaagcccuagaaaacuggaaacaaaucguagaccgaacgcuaaaagauaagauacgcgaacucaucggcgcauacggcaaguacgacgcacaaacaaucuugaaauauuucaaggaccgcgacuauaaauuuaacaaccucaaaaucaacagaguagaggucuaugaguaugaccacaacugcgccgcagucaggaagucgaucggagacgaucuaacuauaaaacaaaucgagcgcauaaccgacgaaucgauacguaaaauccuaaugaaccaccucucaaacuacgacgacaaccucaaggaggcauuuucccccgagggcuuaauggaaaugaacaaaaacaucaaggagcucaacggaggcaaaaaccaccaacccaucuacaaaguacgccuauuugaagaccucggaagcaaguucccacucggaguuagccacaacaaccccgacaaauacgcaaucgcugcaaagggaaccaaucucuucuuugggaucuacgaagaccaagaaggaaaaagaauguucgacagcaucccccucaacaucguaauugacagacucaaggagaaaaagucuccagugcccgagaccuauaacgagagcaaacucaaguuccaucugucacccaacgaccuaguauacgugccgacugacgaggagcaaaaacaacccgaacuuguagacguggaccaucucagcgaugaacaaaagggccgcguuuacaaggcaguaucauuuacaggcaaucgcgcuuucuucgucaaccacaggguaagcaagguaauacacgacuacguagaguucggcacaaagaacaagaucgaaaacgacgacgacaaacgcucccucaaacacaucugcuggaaacucaaggugaaccgccucggcgaaaucacggacgugaaacgauga

SEQ ID NO: 6899 - RNA, 4515 nt, Artificial Sequence
  Cas9 variant
augaaaaacaucguaggguuggaccuaggcaccaacuccauuggcugggccgucguaaacggaucgguaaacgacgacgguuccgaacagcucgugaagauccaagccagcggaucgcgcaucaucccaauggaugcggccaugaucggagacuucaacaaggggaacagcaucagucagacagccgaacgaacucgacugcggggagugcguagacucuccgaaagauaccuccuacgccgcgaaaggcuccauagaauccucgacauacucggauucuuaccguuccacuucgcccaggaccucgacagacacggaaaaauugucaagggcaaagagccaaaacuagccuggcggaagaacgaagcaggccaauucgaguucaucuuccaagacuccuucaaggaaaugcuagaagacuucaagcuaaacuacccgaaucucauaacagacgauaagaaaguccccuacgacuggaccauauacuaccuccgaaagaaaggacugacgagcaaaauauccaaagaagaauuagccuggauccucuuaaacuucaaucaaaaacgcggguacuaccaacuacgcggcgaagaagaggaggagaacaaggacaagcucgucgaguucuacgcacuuaaaguaguagcgguagaagacagcggcgagaagaaaggaaaagacaucugguacaacgugcaccuagaaaacggauggguauaccggcgcacauccaacaugucucuagacuggguagggaaaaccaaagaguucaucguaacgacggaucucgaaaaagacggcacaccaaagaaagacaaagaaggcaacgugaagcgaaguuuccgggcccccaaagaagacgacuggucccuaguaaagaaaaagacggaagcggacaucgaucagacgcacaaaaccgucggggccuacauuuacgacacucuccuaggcaaccccagucaaaagauacgcgggcggcucguacgcaccaucgaacgcaaguacuacaaggaagaacucaaacugauccuagaaaagcagaaagaguuccaccucgaauuacaggaucgcgcgcucuacgcagccugcaucgaagaacucuacccgaucaacgaagcccacaggaacaacguaggcaaccgggauuuuacauaccuguuccuggaggacauucuuuucuaccagaggccacucaaaucgaaaaagagccucaucgacaacugcccguacgaagaaaaccagggccucgacaaagaaacgggggaaauaaaaucauuucccgugaaauguauugccaaaucgcacccgcucuuucaagaguuccggcuguggcaauucauuauaaaccugagaaucuaccggaaagacuuagcccaggacguagacgucacaaacgaacuacuaaaaaccgaagaagauuacguagcacuauucgacuggcugaacgggaaaaaggaaauagaccaaaaagcguuccucaaauacccaguauucgggcuaaagaaagaaauagagaacuaccgguggaacuacguacaggauaaacccuaccccugcaacgagacccggucccucaugcucgcacgccucgagaaaugcgacauaaguaucgaguuccuaacaaaagaaaacgaagaagccuuauggcauauacucuauagugucgaagacaaaaacgaaauagugaaagccuuacaaaaauuugcggauaaacacgaccuaaacgccagcuucguagacgucuuccaaaaauucccaccauucaagaaagaauacggcagcuacuccgcaaaagccauaaagaaacuuuuaccacucaugcggaugggaaaauacuggagcgaaaacucaaucgauaagggaacccgcgaacgaauugacaaaauaaucaccggagaauacgacgagaaaaucgaaaacagagugcgggaaaaagcaauccaccuagccgacgugucagacuuuaaaggacucccccucuggcuuguauguuauaucguguauggcaggcacuccgaggccaaggagaucauacaauggaaauccccugcagacauagacucauacuugagguccuucaaacagcacucacuacgaaacccaaucguugagcagauaauaauagaaacccuacgugugguccgcgacaucuggaaacaaguaggcaacauagacgagauacauguagagcuaggccgcgaaaugaagaaccccgcagauaagcgaaagaaaaugacgcaacagaugagcgaaaacgaaaacacgaaccuaagaaucaaauaccuacucaccgaauuucucaacccggaguaugaaguugaaaauguuagacccuacucaccaucccaacaagacauccuccgcaucuacgaagaagguguccucaacagcguaagcgaccuaccagaagagauaucggacauccucaagaaguucaccgagacagaucucaagaaacgcccaucgcgcucagagguucucagguacaaacucuggcucgagcaaaaguaccggagcccauacaccggcgaggugauaccgcucgguaaacuuuucaccccggcauacgaaaucgaacacgugauaccacaaucguauuacuucgacgacagcuucucgaacaagguuaucugugaagcagaagucaauaagcucaaaagcaaccuccuggggcacgaguucaucguaaaacaccacggggaaaucguagaauuacccuucggcaagaaaguccggauuuucacaguugacgaauacgaacaauucguaaaagacaacuauagccguacccgauccaaaaugaaaaagcuacucauggacgacauucccgaagaguucgucacccgacaacucaacgacucacgguacaucucaaaaguggucaaaagccuccuguccaauauuguacgagaaaagggggaagaagaggcaauaaguaaaaacgucauucccugcaccggcggcguaacugaccgucucaagaaagacuggggcauaaacgaaguauggaacaaaauaauccugccccgauuccagagacugaacgaacuaaccgggaccaacaaauucacgaccaaaaacgucgggauucaggagauuccgaccaugccacuggagcuacaaaagggauucaacaagaaacgaauagaccacaggcaccacgccauggacgcgauaaucaucgcaugcgcaaacagaaacaucauaaacuaccucaauaacaaaucagcuaccgccaaggcagagcuuucccgguacgaccuacaaaagaugcucugcgacaaggccaagaccgacaacaacggcaacuacaaaugggucauacgaaaaccgugggcgucauucacacaagacaccuaucuagcacucgagaacauaauugucuccuucaaacagaacuuacgagucaucaauaaagcuacuaaccgcuuccuccacuacaacgaagaaggcaagaaaauauucguaaagcagggaaagggagacaauugggcgauaagaaaauccaugcacaaagacaccguguucggagaaguaaaccuccggcguaucaagaccguagcucucaacgaagcuaugaaaaacccccaauccauagucgucaaagacuucaagagaaaacuccuagagcucuggaaccucgguuucgacgccaaacgaaucaagaaguacuucgaggacaacagagaaaccuggagcgauauaaaccucagcaaaauagaggucuacuauuuuucuaaagacacuaaagaccgauucuuugcgacucgaaaaccgcuagauaccucauucgaccgcaagaaaaucgagaacaacaucaccgacacggggauacagaaaauccuccuccgccaccuugagcucaaggacaacaacccggauaucgccuucagcccggacggaauagacgagaugaaccguaauauuauccaacuuaacaacgguaaauaccaucaacccaucauuaaaaucagaugguacgagcaagcggacaaauucgccguaggacagaccggcaacaaaagcagcaaguucguagaggcggcgaagggaacaaaccuuuucuucgccgucuacgaaagcaacaucuuagacaagaaaaccaauaccauaauaaagaaacguaacuacgccaccauuccacucaacguggccaucgagcggcaaaaacagggucuacccgucgcccccgaggaugagaacggcaacgacccaaucuucguucugagcccgaaugaccucgucuaccuccccacagacgaugaauuagcgaauggcauaaucgcccagccccucgaccgaggacggaucuacaaaaugguauccagcuccggggagcaaugcuucuucauaaaacacauuguagcaaacguacucgucgacaaguucgaguucagcccgcuaaacaaaauggagcgagcccucacaggcgaaaugauaaagaugaucugcaucccaaucaaaguagaccggcuaggcaacgugcuggaguccagcuccucguacaaaaaguga

SEQ ID NO: 6900 - RNA, 4515 nt, Artificial Sequence
  Cas9 variant
augaaaaacauagucggccuagaccuuggcacgaacucuaucggcugggccguggucaacggaucaguaaacgacgacgguucggagcaauuagucaaaauacaagcaagcggaucgcgcaucauccccauggacgccgcgaugauaggggacuucaacaaaggaaacucgaucucccagaccgccgaacgaacccgccuacgcggcguaagacgccuaagcgagcgauaucucuuacgacgagagcggcugcaccgcauccucgacauccuaggcuuucuaccguuccacuuugcacaagaccucgacaggcacggcaaaauagugaaagggaaagaaccaaagcucgcauggcgcaaaaaugaagcaggccaauucgaguucaucuuccaagacucauucaaagaaaugcuagaagacuucaaacuuaaccaucccaaccucauaacggacgacaaaaaggucccauaugacuggaccauauacuaccugcgaaagaaggggcucacaagcaaaaucagcaaggaagaacuugccuggauccuucucaauuucaaccaaaaacgcggauacuaccagcuccgaggagaagaggaagaggaaaacaaaaacaaacucguagaguucuaugcucucaaagucguagccgucgaagacucaggcgaaaagaaagggaaggacaucugguacaacguacaucuugagaacgggugggucuacaggcgcaccuccaacaugccccuggacugggucggcaaaaccaaagaguucaucgugacgacugacuuagaaaaggacgggaccccgaaaaaggacaaggaaggcaacguuaaacgguccuucagagcgccgaaggaagacgauuggucacugcuaaagaagaaaaccgaggcggacaucgaccaaacacacaaaaccgucggcgucuacaucuacgacacacugcucgguaaccccagucagaagauacgcggccgccuagucagaacaaucgaacgaaaguacuacaaagaggaacuaaaacaaaucuuagagaaacaaaaagaguuccaucuagaacuacaagaccgggcacuauacgcggcaugcauagaagaacucuaccccaucaaugaagcccaccgaaacaauguggguaaccgcgacuucacauacuuauucuuagaagacauccuguucuaccaacgaccccuaaaaaguaaaaagucacucaucgacaacugccccuacgaagaaaaccaaggauuagacaaagagaccggcgaaauaaagagcuucccaguaaaaugcaucgccaaaagccacccuuuauuccaggaguuccgacucuggcaauucaucguaaaccuacgcaucuaccgcaaagaccuggcccaagacgucgacgucaccaacgaacuucucaagacagaagaagacuacguugcccuuuucgacuggcuuaacgggaaaaaggaaaucgaccaaaaggcuuuccugaaauaccccgucuucggacucaagaaagaaauagaaaacuaccgauggaauuacguccaagauaaacccuacccuuguaacgaaacccgcagucucaugcuugcaagacuagaaaagugugacauauccauagaguuccuaacaaaagaaaaugaagaggcccuguggcacauacucuacuccgucgaggacaaaaaugaaaucgucaaggcccuccaaaaguucgcagacaagcacgaccuaaacgcuucuuucguggaugucuuccagaaauucccaccguuuaagaaagaguacggcuccuacucggcgaaagcaaucaagaaacuauuaccauugaugaggaugggcaaguacugguccgagaacagcaucgacaaagggacaagggaacgaauagacaagauaaucaccggagaguacgacgagaagaucgagaaccggguuagagagaaggccauccaccuggccgacguaucugacuuuaagggacuaccacuuuggcucgucugcuacauugucuacggacgacacagugaggcgaaagaaauaacccaauggaaaucaccagcggauaucgacaguuaccuucgauccuucaaacaacacucccuacgaaaucccauuguggagcagaucaucauagagacacuuagaguagucagggacauauggaagcagguaggcaacaucgacgaaauccacgucgaacuaggacgcgaaaugaagaacccugcggacaaacgaaagaaaaugacacaacaaaugagcgaaaacgaaaacacaaaccuccgaaucaaauaccuacucaccgaguuccucaacccggaauacgagguugagaacgugcgaccguacuccccaagccaacaagacauccugcgaauauacgaagaggguguacuuaacagcgucucagaccucccugaggagauaagcgacauccuuaagaaauucaccgaaaccgaccuaaagaaacgaccguccaggucggaaauccuccgauauaaacuguggcuggagcagaaauaccguagccccuacacaggagaggucaucccccuagggaaacuguucacucccgccuacgagaucgagcacguaaucccgcagagcugcuacuucgacgacuccuucucgaauaaagucauaugugaggcagaggucaacaaacuaaaaucaaaucuccuuggccaugaguucaucgucaaacaccauggcgaaaucguagaauugccuuucggcaaaaaggugcgcauauucaccguagaugaauacgaacaauucgucaaagacaacuacucgcguacccgaagcaaaaugaagaagcuacucauggacgacauccccgaagaguucguuacccgccaacuaaacgauucacgcuacaucagcaaagucgugaagucacuccuaagcaacauuguccgugagaagggagaagaggaggccaucuccaagaacgugauaccaugcacgggaggggucacagaucgccuaaagaaggacuggggcauaaacgaggucuggaacaaaauaauccuuccgcgcuuccagcgccucaacgaacucacuggaacaaauaaauucaccacuaaaaacguuggaauccaggaaaucccuaccaugccgcucgagcuacagaaagguuucaacaagaaacgcaucgaccaccggcaccacgccauggaugccaucaucaucgccugugccaaccgcaacaucauaaacuacuuaaauaaugagagugcgaccgccaaagccgaacuuagcagauacgaccuacagaaaaugcuaugcgacaaggccaaaaccgacaacaacggcaauuacaaauggguaauucgcaagccaugggccucauucacucaagacacauaucuagcacuugaaaauauuauuguaucauucaaacaaaacuugcgagucaucaacaaagccaccaaucgcuuuuuacauuacaaugaagaaggcaaaaagauauucguuaaacaaggaaagggugauaacugggccauacggaaauccaugcacaaagacaccguauucggggaaguaaaccuccgccgcaucaaaacgguagcauuaaaugaagccaugaaaaacccccaguccauaguaguaaaggacuucaaaagaaaacuacucgaacucuggaaccugggcuucgacgcaaagaggaucaaaaaguauuucgaagacaaccgagagaccuggucagacauaaaccugagcaaaauagagguguacuauuucuccaaggacaccaaagacagguucuucgccacccgcaaaccccuagacacgagcuucgaccggaaaaagaucgagaacaauauaacagauacaggcauacagaaaauccugcuaagacaccuggaacucaaagacaacaauccugauauagcguucucacccgaugguauagacgaaaugaaccgcaacaucauccaacugaacaacggaaaauaccaccaacccaucauaaaaauaagaugguacgagcaagcagacaaguucgcagucggacaaaccggcaacaaauucuccaaauucgucgaagcagcaaaagggaccaacuuauucuucgccgucuacgaguccaacauacuggacaagaagaccaacaccaucaucaagaaacgaaacuacgcaaccauaccccucaacgucgcuauagaacgccaaaaacagggcuuaccuguugcacccgaggacgaaaacggcaacgaccccauauuuguucucaguccgaacgauuuggucuaccugccaacagaugacgaacuggcuaacggaaucauagcccaaccgcuagaccgcggacggaucuacaaaauggucucaugcacaggcaacgaagggcacuucaucccugcaagaaucgccaacccgauucuacaaacgaucgagcucggcuccaacaacaaagcacaaaaggcguggacugacgaaaugauaaaagaaaucuguaugcccauuaaaguagacagacuggggaacguacucgaguccucgagcuccuacaagaaauga

SEQ ID NO: 6901 - RNA, 4521 nt, Artificial Sequence
  Cas9 variant
augaaaacgauucuaggccucgaccuaggcccaaacagcauaggaugggcuaagguggaggucgaugaugagggcaacuaccuuaggaacaucaaacucgguucucgaauaauaccaaugacgcaagauaugcucggagacuucgauaagggcgugaagguaucacaaaccgcaauccggaccgacuuccggggaaauagaagacuaauagagcggcaccuucuacgaagagagcgcuuacaccgcguacuucacgcccucaaauuccugccaaaacacuacgaggacgcuauuggaugggacaggaacgaaccugcuacauacggcaaguucgucaauaacucggaacccaagcuagcaugggagcgacaggaggacggcuccaugagguuccuauucauggagagcuucaaugaaaugguggcagauuucgcccagaaucaaccgucccucguaucggacggcaagaaaaucccgcucgauuggacgauauacuaccuccgcaagaaagcauuaacacgcccuaucaagaaagaagaacucgcuuggauccuacugaacuucaaucaaaagcgaggcuauuaccaacugcggggcgaagaagaagaagacaaccuaacgaagcggaaggaguacuauaaacuuaagguggucggagucgaggcagacggcgcgccaaagggaggcaaaacuugguauaacauccaccucgagaacggauggaccgcacggugucagagcaaaaucccccucgacgacugggugggcaaggucaaagaguacauugucacaacagaauaugaagacgacggcaaaaccccgaaaugcgacaaggaaggcaaggucaaacgguccuucaagucaccggaaaaggacgacuggcagcucaucaaaacccgcacugaaaaguucauagacgacuccaauaaaacgguuggcgccuucaucuaugacuaccuauuggaaaagcccuucgacaaaauacgaggcaaguacauccgcacgauagaacgaaaguacuacaaaaacgaacuacgagaaaucuuaagagaacagaccaaauaccacgaagggcuacacucacuagaggcacugaaaaucugugcagaggagcucuacaaaaacaaucagcagcaccaagaauaccugcuaaagaaagacaugacguuccuacugcuuaacgaccugauuuucuaccaacgcccgcucaagagcaagaaaagccucaucgcggacugccccuacgaagucuacaaauacgacgacaaacucacaggaaagaaagggcaaaagaaaaucaaaugcauugcgaaauccaacccguacuaccaagaguucagacuguggcaguucaucgcgaaccuccgacuguucagcgucaccgauggcaaagaagucacagcggaauaucucaaaaccgaggaggacuacguccgccuauucucauuccuaaacgacagaaaagacauuaagcaggaaaccuuucuccgcagcuuccuuaaacuuaagaaggaaagcaucggcuccgaaaagaucuaccccauacgcuggaacuacauugaagacgcaaauaaaagcuacccaugcaaugcgaccagacacgaacugcuccucgccuucgaccgugcagacaucccccgagagcuccucgacguagaagaaagggaguaccgccuauggcaccuacuguacagcaucgaagcgaaggaagaaacggaaucagcccuucgaaaguuaaaggccaacaaagcguucggggaccuaaacaucgacgaugcguucguuaacagcuuucucaaaauaaaaccguucgaaaaagaguacggagcauacagcgaaaaagccaucaagaaacuccuagccgucaugcgccgcgguucccucuggaaagaggcagauaucugcgaagcgacaaaacaaaacaucgccaagauccuccagaacgacauagacgaaaagcuaaagaagaaaaucgaagccgcagucagcaguuucaacaaacuaucagacuuucaaggucucccaacauggcuggccuguuacgucguauauggcagacacagcgaagccgcccagauacaaugcuggcaaucacccgaagaccucaaaacuuacaucaacaaauucaagcagcauagccuacggaacccgauagucgaacaaugccuccucgagacacugcgcacaguauacgacaucuggaaagaugcgggccagauugacgaaauacauauagaauuggggcgcaacaugaagucaacugccgaacaacgcgcaagaaagacuaaagacaucuugcguaacgaaaacaccaaccuccgaauuaaaaaucuccuagucgaguugaagaacgacgacaaaaucgagaacgugcgaccauacagcccgagccaacaggagauccucaggaucuacgaggaaggcgcucuccaagagcugagcaaggaagacgaaauguucgaggacaucuccaaaauaucaaaaauggcucagccaucaccgacagaacucagucgguacaagcucuggcucgaacaaaaguacagaucgcccuacacaggcagaguuaucccgcuuuccaaacuguuuaccacggcauaccaaaucgaacacauaaucccacagucccgcuacuucgacgauagcuucaacaacaaggucauuugcgaaagcgaagucaacucacucaaagacaacauguugggauacgaguucaucaaagaaugcggcggccgcaucguccacugcacgcuccucggcgaugucaaaaucuucacuaaagaagaauacaaagacuucgugacgaaacauuacauugacaacacauacaaacgagacaaacuccuccucgaagacauaccccaagaguucuccgcccgacaacugaacgacucccguuauaucagcaagaugguccaaaccguucucucaaacauaguccgcgccgaaaacgaacaagaagccaccucaaaauucgucguuuccugcaacggagcgaucaccaaccggcuaaagaaagacuggggauugaaugacguauggaguucaauaguuugcccacgauucaaacgacuuaaugaaauaaccaaaaccaacgccuucggacacugggaagacaaagcaggaaaacacguauuccaaacgaccgugccccuugaacuacaacgcggguucagcaaaaagcgcauagaccaccgccaucacgccauggacgcccuaguaauagccugcgccucacgaaacaucgucaacuaccucaacaacgaguccgcaaacucaccagagaaacgagaggaccugcgcaagaaacuaugcgacgagaaaagaaagauccgaaaaccauggaagacauucacacaagacgcacgagaagcucuaucggacgucgucguaucauuuaagaacuauguaagagugaucaauaaggcaaccaacuacuacgaacacuacuccagcucaggcaacaaaguaaugauaagccaaaagggcaacgauaugugggcaauccgcaaaccacuucacaaggaaagcgucuuuggcaggguaaaccucugucgaaaagucauagucucccucaagaaagcccuagaaaacauaccggcaaucugugauaaaacauuacgcgacuauaucaacgcgcuagucgagaagcacuucaacacgcgacagcugcuagcccauuucaaauccauaaacuaccgcuuaaaccgacagugcgucgagaaaguggaaguauggcaguucucagacgagaaaaucgaaaugguagcccgaaggaaaucccuagacaccagcuucgacgacaaacaaauauccaguauaacggauaccggcauucaaaagaucuuacuaaacuauuuacaaaccaaagacggcaaugcugaaauagcguucacucccgaggggauagaagaaaugaacaaaaacaucucucuauauaaugacgggaaagcccaccaaccaaucuugaaaguccgcguagcgacacccaaagguaugaaauaccccguaggacaaaccggcaacaaagcaacaaaauucgucguugccgaaaaaggcacgaaccuauacuuugcgaucuacgagaacgaacucggaguccgcucauaugacacuaucccauuaaacaucguggucgagcgacuaaaagaaggccugagcccggucccccaagccaacgaagcggacauccccuugaaguucuaccuuagcccaaacgaccugguauacguaccaacaaaagaaaacgaagacgagcuuugccgcgaccgaauauacaaauucgucgauucaucuggcaccaccgccaacuuuguuccgcacacauccgcuaacaccauauacaacguggacaaagaauaugccgagaaauguuguaacggagcagucuucuugaacgaguacggccucgggagcccgcaauccaagaaccagagggccuuaacaggggaaaugauaaaggaaauaugcuggaaguuaaaaguugaccggcucggaaacaucaucaaagucaucaaauga

SEQ ID NO: 6902 - RNA, 4530 nt, Artificial Sequence
  Cas9 variant
augaaaaauauuguaggguuggaucucgggacgaauagcauaggaugggccgugguaaacgggucggugaacgacgacgguagcgaacaacuugucaaaauacaggcaagcgguucacguauaauacccauggacgcggccaugauaggcgauuucaacaaaggaaacucaaucagccaaacggcagaacgaacccgccuccgagggguccgucggcucagcgagcgauaccuacuccggcgagaaaggcuccaccgcauucucgauauacugggcuuccucccauuccacuucgcccaggaccuagacagacacggaaaaaucguaaagggaaaggaacccaagcucgcauggcgaaagaacgaggccggccaguucgaguucauauuccaggacagcuucaaagaaaugcuggaagacuucaaacucaaccaccccaaucugaucaccgacgacaagaagguacccuacgacuggacuaucuacuaccuccgcaagaaaggucucaccucuaaaaucuccaaagaagaacucgcguggauacuucucaauuucaaccaaaagcggggauacuaccaacuccgcggggaagaggagaaaaagaacgacaacguaaugauaaucaauucaaaagucaucgaugucguaaaggcggaaaaagauaagaaauacgagaaauacugguacaacguacuacucgaaaacggucugcuauaccgggcagccuucuauaacgacauaucauucuggaaaggccauacuaaagaauuuguccuaaaaacgauaaaacuaaaaagugggggcacgaaacaagagcuuucauuccuaccguccuucgacgaaaucgagaaaauggaaaagaaacaaaaggacaaaauguacuucaaaauaaaacucaagacagaagccgauaucgaccaagcccacaaaacgguuggaaccuacaucuacgacacgcuacucgguaaccccucacagaaaauacggggaaggcuggucaggaccaucgagcggaaauacuacaaagaggaacuaaaacugauacuggacaaacagaaggaguuccaucccgaacuacaggaccgagcccuauaugcggcaugcauugaggaacuauaccccaucaaugaggcccaccgcaauaaugugggaaaccgcgacuucacauaucuauuccuagaggacauacucuucuaccaacgaccccuaaaguccaaaaagagccugaucgacaacugcccauacgaagagaaccagggacuagacaaagagacaggcgaaaucaagagcuuccccguuaaaugcauagccaaaucgcacccccuauuccaggaguuccgguuguggcaauucauaguaaaccuacgcauuuaccgcaaagaccuagcacaggauguugaugugaccaacgaauuacucaaaacugaagaagauuauguagcccuuuucgacuggcuuaacggaaagaaagagaucgaucaaaaagcguuccugaaauacccaguauuuggccuaaagaaagaaauugagaacuacagauggaacuauguacaggacaaaccguaccccugcaaugaaacacggcuacucaugcucgcaagacuggaaaaaugcgacaucucuaucgaguuccuaaccaaagagaacgaggaagcccuauggcacauacucuacagcgucgaagacaaaaacgaaaucguaaaagcccuucagaaauucgcggacaagcacgaccucaacgccuccuucguagacgucuuccgaaaguuucccccauucaaaaaggaauauggcaguuauucugccaaggcgauaaagaaacuucuaccccuaaugcguaugggcaaauacuggagcgaggacuccaucgacaaggguaccagaaagcgcauggacaaaauaauaacaggcgaauacgacgaaaagaucgaaaaccggguaagagaaaaagugauacaccucgccgaugucucagauuuucggggacucccacuguggcuagucugcuacauugucuacggccgccacucggaagcaaaggaaauaacccaguggaaaagccccgcggacaucgacagcuaccuaaaaucguucaaacaacacucgcugcgaaaccccauagucgagcagauaauaauugaaacccuccgcgucguucgggacaucuggaaacaagugggcaacauagacgaaauacacguugagcucggcagagaaaugaagaacccggcggauaagaggaagaaaaugacacagcaaaugagcgagaacgaaaacaccaaccugcgaaucaaauaccuccucaccgaguuccucaacccggaauacgaagucgaaaacgucagacccuacagccccagccaacaagacauacuacggaucuaugaagaaggaguccuuaacagcgucucagaccuaccagaggaaaucucagacauccuaaagaaauucaccgagaccgaccucaagaaacgccccucucgguccgaaauccuccguuacaaacucuggcuagagcagaaguaccgcagccccuauacgggagaaguaauaccccucggcaaacucuucacucccgccuacgaaauagaacacgucaucccccagagcugcuacuucgaugacucauucagcaacaagguaauaugcgaggccgagguaaauaaacuaaaaagcaaucuccucggccacgaguuuaucgucaagcaccacggggaaaucguggagcuccccuucggcaagaaaguacgaauuuuuaccguggacgaauaugagcaauucgugaaggauaacuacucgaggacacgcgggaaaaugaagaaacuacuaauggacgacauacccgaagaguucguagcccgacaacugaacgacucacguuacaucucaaaaguugugaaaucccuccuaucaaacaucguccgcgaaaaaggggaagaagaggcaaucuccaaaaacguaaucccguguaccggcggggugacagaccgacuaaagaaagacuggggcaucaacgaggucuggaacaaaauaauccucccccgcuuccagcgccuaaaugagcucacgggcacgaauaaauucaccaccaaaaacguuggcauacaagaaauccccacaaugccacucgaauuacagaaaggcuuuaacaagaaaagaauagaccauagacaccacgcaauggacgcaaucaucauugccugcgcaaaccggaacaucauaaauuaccucaacaacgagagcgccaccgcgaaagcugagcucuccagauacgaccuacaaaaacugcucugcgacaaagcaaaaacggacaacaacggaaacuacaaaugggugauccgcaaacccugggcuagcuucacgcaagacacguaccucgcacuggaaaacaucaucgucagcuucaaacaaaaucugcguguaauaaauaaagccacaaaccgauuucuccauuacaacgaggaagggaaaaagaucuucgucaaacagggcaaaggugacaacugggccauccgcaaaagcaugcacaaagauaccgucuuuggcgaggugaaccugaggaggaucaaaacuguugcgcugaacgaagccaugaagaacccccaguccaucguugugaaagacuucaaacggaaacuccucgagcucuggaaccucggcuucgacgccaagcgaaucaagaaauacuucgaagacaacagggagaccuggucagacauaaaccuguccaaaaucgaagucuauuacuuuagcaaagacaccaaggaccgcuucuucgcaacaagaaaaccccuggacacaaguuucgacaggaagaaaauugaaaacaacauuaccgacaccggcauucaaaagauccugcugaggcaccucgaauugaaagacaacaacccagacauagccuucucacccgacggaauagacgaaaugaaccgcaacauuauacagcucaacaacgguaaauaccaccaaccaaucauaaaaauaagaugguacgaacaagcggacaaauucgccgugggccagacugggaauaaauucagcaaauucgucgaagcagccaaaggcacaaaccuauucuuugccgucuacgaaucgaacauucucgacaaaaagacgaacacaaucauaaagaaacgcaacuacgcaacgaucccccucaauguagccaucgaacgccagaaacaagggcucccagucgcccccgaagacgagaacggaaacgacccaauauucguacuuuccccaaacgaccuagucuaucucccgacagaugacgaacuagcaaacggcaucauagcgcaaccgcuagacaggggccgaauauacaagaugguaagcugcacgggcaacgagggacacuuuauccccgcccgcauugcaaaccccauccuacaaacgauugagcuaggcaguaacaacaaggcccaaaaagccuggaccgacgaaaugauaaaagaaaucugcaugccaauaaaaguggaccggcuggggaacguccuagaaagcuccuccagcuacaagaaauga

SEQ ID NO: 6903 - RNA, 4530 nt, Artificial Sequence
  Cas9 variant
augaagcggauucugggccuagaccuggggacgaacucaauaggguggucacucaucgagcacgacuucaaaaacaaacaaggccaaaucgaaggacugggcguccgaaucauacccaugucacaagagauccuaggaaaauucgacgccggccaaaguauaucucagaccgcggacaggacgaaauacaggggcgugagacggcucuaucaacgcgacaaccuacgucgagaacgacuccacaggguacuaaaaauccuggacuuccuacccaagcacuacucagagagcauagacuuccaagauaaaguaggccaauucaaacccaaacaggaagucaaacucaacuaccgcaagaacgaaaagaauaaacacgaguucgucuucaugaacagcuucaucgaaaugguauccgaguuuaagaaugcgcaaccugagcuguucuacaauaaaggcaacggcgaagaaacaaagaucccauacgauuggacccucuacuaccuuaggaagaaagcccuaacacaacagauaacgaaagaggagcucgcauggcugauucucaacuuuaaucagaaacgcggcuacuaccagcuccguggcgaggacauagaugaagacaaaaauaagaaauacaugcagcucaaaguaaacaaccugauagauagcggagccaaagucaaaggcaaggugcucuacaacguaauauuugauaacggauggaaguacgagaagcaaaucguaaacaaggacgagugggaaggccgaaccaaggaguucauaaucacgacgaagacccucaaaaacggcaacauaaagcgcacguacaaagccguugacuccgaaaucgacugggcagcaauaaaggcaaaaacugaacaggacaucaacaaggcaaauaaaaccguaggcgaauacauauacgaaagccuacuagacaacccaucgcagaaaauccgagggaagcucguaaaaacgaucgagcgcaaguucuauaaagaggaguucgaaaaacuccucagcaaacaaauugaauuacaacccgaacucuucaacgaaucacucuacaaagcaugcauaaaagaacuguacccacgaaacgaaaaccaccaguccaacaacaaaaagcaaggauucgaauaccuauucaccgaagacaucaucuucuaccaacgcccguugaaaucgcagaaaagcaacauaagcggaugucaauucgaacauaaaauauacaaacaaaagaauaagaaaaccggcaaacucgagcugaucaaagagcccaucaaaacuauaucacguucgcacccacucuuccaagaguuccgcaucuggcaguggcuacaaaaccuaaaaauauacaacaaagagaaaauagaaaacggcaaacucgaagacgucacaacgcaacuccuuccgaacaaugaggccuacgugacccuauucgacuuccucaacaccaagaaagagcuagagcaaaaacaguucauagaauauuucgucaaaaagaaacucauagacaagaaagaaaaagaacauuucagauggaacuucguagaagacaagaaauaccccuucagcgaaaccagagcccaauuccuaagccggcucgcuaaaguaaaaggcaucaaaaauaccgaagacuuccucaacaaaaacacccaaguaggcucuaaagaaaacuccccguucauaaaaaggaucgagcaauuauggcacaucauauacagcguuagcgaccuaaaagaauacgaaaaagcacucgaaaaguucgcagaaaagcacaaccuagaaaaggauucguuucucaaaaacuucaagaaguucccacccuucgugucagacuacgcauccuacagcaagaaagcgaucucaaaacuccuccccaucaugcgcaugggcaaauacugguccgagagcgcaguacccacccaagucaaagagcgaagccugucaauaauggaaagggugaaaguacuaccacugaaagagggcuacucggacaaagaccuugcggaccuccucucacgcgucagugacgaugacauucccaagcaacugaucaaauccuuuauuucuuucaaagacaaaaacccacuuaagggacuaaacacguaccaagccaacuaccugguuuacggccgacacagcgaaacuggggacauacagcauuggaaaaccccggaggacaucgaccgguaccuaaacaacuucaaacaacauucucuccgcaaccccauugucgagcaggucgucauggaaacccuacggguaguacgagacaucugggaacacuacggcaacaacgaaaaggacuucuucaaagaaauccacguagagcucggccgagagaugaaaucccccgccgguaagcgcgaaaaacucucacagcgcaauacagagaacgaaaacacgaaucaccggauccgugaaguacuaaaagaacugaugaacgaugcauccgucgagggcggcguuagagacuacuccccgucucagcaagagauccugaaacuauaugaagaggggaucuaucaaaaccccaacacaaacuaccuaaaaguggacgaagaugagauccuaaagaucagaaagaaaaacaauccgacacaaaaagagauacaacgcuacaaacuguggcuagaacaaggauauauaucuccauacaccggaaagaucaucccacucaccaagcuauucacccacgaguaccaaauugagcacaucauaccacaaucucgcuacuacgauaacagccugggcaacaagaucaucugugaaagcgaaguuaacgaagacaaagacaacaaaaccgccuacgaauaccuaaagguagaaaaggggucaauaguguucggccacaaacuccucaaccuagacgaauacgaggcccacguuaacaaguacuucaaaaagaacaaaaccaagcucaaaaaccuccuguccgaagacaucccagaaggguucaucaacagacagcuaaacgauucgcgcuacaucucgaagcugguuaagggccuguuguccaauauaguccgagaaaauggggaacaggaggcgacgagcaagaaccucaucccuguaaccgggguagucaccagcaagcugaaacaagacuggggacugaaugacaaauggaacgaaaucauugcaccgcgcuuuaagcgauuaaauaaacucaccaauucaaacgacuucgguuucugggacaacgacaucaacgcauuucgaauacaaguuccagacucgcucauuaagggcuucucgaaaaagcgaauagaccaccgccaccaugcguuggacgcgcuagucgucgccugcacgagccgcaaccacacgcauuaccugucggcccucaaugcggagaacaagaacuauucacuccgcgacaagcuagucaucaaaaaugaaaacggugacuacacgaaaacguuccaaauccccuggcagggauucaccauagaggcgaaaaacaaccuagagaaaacaguagucuccuucaagaaaaaccugcggguuauaaauaaaaccaacaacaaauucuggagcuacaaagacgagaauggcaacuuaaaccucggcaaagacgguaaacccaaaaagaaacuacgcaaacaaaccaaaggcuacaacugggccauucggaaaccccugcacaaagaaacggucuccgggaucuacaacaucaacgcgccuaaaaacaaaaucgcuaccuccguaagaacccugcugaccgaaaucaaaaacgagaagcaccuagcaaaaaucacagaccucaggaucagagagaccauccugccaaaccaucugaaacacuaccuaaacaauaaaggcgaagcgaacuucagcgaggccuucucgcagggcggcaucgaagaucuaaacaagaaaaucacaacucuaaacgagggaaagaaacaccaaccuaucuaccgcgucaaaaucuucgagguagggagcaaauucagcauauccgaagaugagaacagcgccaaaucgaagaaauacgucgaggccgccaaagggaccaaccuuuucuucgccaucuaccucgaugaagaaaacaagaaaagaaacuaugagacaauaccacucaacgaagucauaacccaccagaaacagguagcaggcuucccgaagucagaacgucuaucaguacagccggacucgcaaaagggcacguuccuguucacacuauccccaaacgaucuaguauaugugccuaacaacgaagaacuagaaaauagagaucucuuuaaccuaggaaaccugaauguggaacaaaucagucggauauacaaguucacggacaguucggacaaaacuugcaacuucaucccauuucaaguaucgaaacuaauauucaacuugaaaaagaaagagcaaaagaaacucgacguggacuucaucauacaaaacgaguucggacuuggcucgccacaaagcaagaaccaaaaaucgauagacgacgugaugaucaaagaaaaauguauaaaacuaaaaauagacagacucgggaacaucuccaaagccuga

SEQ ID NO: 6904 - RNA, 4530 nt, Artificial Sequence
  Cas9 variant
augaagaccauacuagggcuagaccucggcaccaauagcguaggcugggccgucaucaacagcgucaucaaagaacaagcagaaagaauuuggauagaaauggccggcagccgaaucauaccaauggacgcggcagugcugggggacuucgacaaagggaacagcaucagucagacgagcgagcggacccgccuccgcggaguucgccgacuacgagagagacaguuacuaaggcgagaaagacuccauaaaguccugaacauucuaggguuucugcccaaccacuaccuagaauauauagacuucgaaaagcacccagggaaguuccugagcgacgcugaaccuaaacuuccuugggugaaagacgagcaagguaaguacacauuccucuuccaagcagcguucgacgagaugcuagcagacuucgcgauacaccaaccgucucuugucaguggagacaagaaaauaccauaugauuggaccauauacuaccuccgaaagaaagcacuaacggagaugaucagcaaagaggaacuagccuggauacuccucaauuucaaccagaaacgcggauacuaccaacugcgcggagaggaagaagaagacaacgcaggaaaaagcguggaguucuacgcacugaaaguccuaaccguagaagcaacugaugagaaaaagggacgcgacgucugguauaacguccaccucgaaaacggcuggaucuaccgacgaucuuccaguguaccccuggacugggaagggcagaucaaagaguucauaguuaccacagaccucaauccagacucgacccccaagcuggacaaauacggggaagugaaacgcagcuuccgagcgcccaaagaagacgacuggauguugaucaagaaacgaacagaagccgacaucgcaaacacccacaaaacagugggagcuuacauauacgacacacuacugcagaaaccgcaacagaaaaucauagguaaguuaguaaaaaccguagaacgaaaauuauaccgcgacgaacuaucacuaauccuccaaaagcaaugcgcauuccacgccgaacuccaggaucgaacucucuacgcacgcugugucgaagcccuguacccaaacaacgaaguucaacggaggaacaucgccaaccgcgacuucgucuaucugcugauggacgauguccuguucuaccagcgcccgcugaaaacgaagaaaagccucaucgccaacugcccauacgaagaaaacgaguacgucgaccgggagacuggcgaaaucaagaaagcgccgcucaaaugcauagcgaaaagccauccccuuuuucaagaguuccgccuguggaacuucuuaagcaacauucggaucuaccaaaaagaaaaggagaucaacggcacacuccacuuggacguggacgucaccgcggaauuucucaagaccgaggacgacuauguugcccucuucgauuggcugaacucccgaaaagaaauagagcagaagaccuuccugaaauacccuaaguucggccugaagaaagaaauaucaaacuaucgcuggaacuacguugaagacaaacaauaccccugcaacgaaacacgccaugcgaucuuaucucgccuugagaaagcuaacgucugcauagauuuccucagcaacgaaaaagaagucgcccucuggcacauccucuacagcgucuccgacaaacaagagaucgaaaaggcucuccguaccuuugcggcuaagaacgggcucgacgaaucguucgucgaagcguucaagaaauucccaccguucaaaucggaauauggggcuuauagcgcgaaagccauaaagaaauugcucccgcucaugcgaugcgggaaauacugggacguaagcucgaucgacgacacaaccaaagagcggaucaagaaaauagucgcaggagaguacgacgagcgcaucgcgguaaaagucagagacaaaguaaugaaccucagcgauauaagcugcuucaaacgccuuccccuauggcuagcaugcuauauaguguacaaccgacacagcgaggacaaagaggcuguuaagugggagaguccggccgauaucgacgcauaccucgcguccuucaagcagcacuccuugcggaacccgauaguagaacaaguuauaaccgaaacuuuaagaguuguccgggacauauggaagcaggucggacgaaucgacgaaauccacauugaacuuggaagggaaaugaaaaacccagccgacaaacgcaaacggaugaccgcgcagauccuagaaaacgaaaacgcaaaccuacgaauuaaggcacuacucgcugaguucaugaaccccgaauacgaaaucgagaacguacggcccuacagucccucacaacaggaaauacuccgaaucuacgaggacauggugcuacacgcagaggaccagcucccagaagaaauugacgccauucuaaagaaguucaacagcucgaaaguaccaacaaaaagcgaguuccuaagguacaagcuauggcuagaacaaaaauaccgcuccccguacacaggagagcucaucccacuaggcaaacuauucaccgcagcauacgaaaucgaacacgugauaccgcaaagcagauacuucgacgacuccuucuccaacaaaguaauaugcgaaucugcagugaacaaacucaaggacaaccaguugggauaugaguucaucaaaaaccaucacggacaaaagguagagguaggguuuggaaagucaguagagauauuuucaguagacagcuacgaaagauucgucaaggaacaauacgccaaaagcgccgugaaaaugaagaaaaugcugauggacgacauccccgaacaguucaucgaacgucagcucaacgacucaagauacaucagcaaagucaucaaagggcuguuguccaacauuguccgugagaagaacgacaguggcgaauacgaaccagaggccgugagcaagaacauagucgucuguaccggcucagugaccgaccgccucaaaagggacugggguaugaaugacguguggaacucaaucguauacccccgauucgaaaggcucaauucacucacagacacccaauccuucggccacugggaaaacaaguccggcaaaaaggucuuccaaacggaacucccgcucgaauaccaaaaaggcuuuucuaaaaagcguauagaccaccgccaucacgccauggacgcgauaguaauagcaugugcuacucgaaaccacgucaacuaccuuucaaaugaauccgcaucccggaacgccaaaaucagccgcuacgaccugcaaaggcuucugugcgacaaauccaggacggacgacaacggcaacuacaaguggguaaucaagaaacccugggacacguuuacacaagacgcccgcgaagugcuauccaaaauaguagugucucucaaacagaaccucagaauaaucaacaaaacaacaaacguauacagacaccuagacgcaaccggcaaccgcgucuacgagaaacaaaagaccggggacucaugggccauucggaaacccaugcacaaggacaccguauucggcgccgugaaucuaagaaaaguaaaagucguccggcucucaguagcccuagacgcgccgacaaugauagucgacaaacgggucaaaaauaaaguauuugaacuccucagcuacaaguacgauaagaaacgaauagaaaaguacuucaaagagaacgccguccucuggaaagaacuugaccuugcacgaguugcggucuauuacuucacggaagccaccaccgaaccccuaguagcaguccgcaaaccacuagauagcaccuucaacgagaaaaagauaaaggaguccguaacagacaccggaauacagaaaauauuacuaaaccacuuaugcacuaaggaggggaaaccagaucuagcauucagcgcggaaggcauagaggagaugaaucggaaucuccuccaacugaacaauggaaagcgucaccaaccgauauacaaaguacgagucuacgaaccgcggggcaacaaguucuccguugggguacuaggaaacaaaggcacgaagugggucgaagcagcaaaagguacaaaccuuuucuuugccaucuacaucacggaagacggcaaaaggacauacgagacaaucccguuaaacauggugaucgagagagaaaagcaaggacucgcgcccgugcccgacaaaaacgaaaagggggacaagcuacucuucugguuaagccccaacgaccucgucuaccuccccaccgaagaggaacuggaauuuggccgcauaaaugaacccaucgaccgaggucggaucuacaagaugguaagcuccagcggcaaccaaugcuucuucauaccacaaagcaucaguaacgccaucauacccacgaaagaacucggcgcgaacaacaaggccgagcggagcugggacggcgcaaugaucaaaaauauaugcauaccagucaaaguggaccgacuagggaggauaaucgaaguaaaauacagaaucaacgaauga

SEQ ID NO: 6905 - RNA, 4530 nt, Artificial Sequence
  Cas9 variant
augaagacuauacucggacuagaccucggcaccaauagcguaggaugggcugucauaaacucagucaucaaggaacaggcagaacgcaucuggauagagauggccggcucacgcauaauuccaauggacgcagcaguccucggggacuucgacaaaggcaacucuaucucucagacgucagaaagaacccgacuccgaggcgcgcgccgccugcgcgaacgccaauuacucagacgcgagcgucuccacaaagugcuaaacauccuagguuuccuccccaaccacuaccucgaauacaucgacuucgaaaagcaccccgggaaguuccuagcggacgccgaaccaaagcuagccuggguaaaagacgaacaggguaaauacacauuccucuuccaagccgcauucgacgaaaugcuagccgacuucgcaauucaccaaccaagccuagucucaggcgacaagaaaauacccuacgacuggacaaucuacuaccuacggaagaaagcacucacggaaaugauaucaaaagaggaacucgcauggauacuccucaauuuuaaccaaaagcguggauauuaccaacuccgcggagaagaggaagaagauaaugcaggcaagucggucgaguucuacgcccucaaaguccuaacggucgaagcgacagacgaaaagaaaggaagggacguaugguacaauguacaccuggaaaauggcuggaucuaccgccgcuccuccuccgugccacucgauugggaaggccagguaaaagaguucaucguaaccacggaccuuaacccagacgguacaccaaagcuagacaaauacggagaaguaaaacgauccuuccgagcacccaaggaagacgacuggaugcuaaucaagaaacggaccgaggccgacauagcaaauacgcacaaaacggucggggccuacauauacgacacacuacuccaaaaaccccaacagaaaaucaucggcaaacuuguaaaaaccguagagcgaaaacucuaccgggacgagcucagccucauccuacaaaaacaaugcgcuuuccacgcagaacugcaggacagagcacucuacgcacggugcgucgaagcccuguaccccuccaacgaaguccgccgcaagaacauagcaaaccgcgacuucgucuacuuacucauggacgacauacucuucuaccagcgaccgcucaagacaaagaagucgcucauagccaacugcccauacgaggagaacgaguauguagacagggagacgggagaaauuaagaaaacaccacuaaaaugcauagcaaagagccacccccuauuccaggaauuucgacuauggaacuuccuuaguaacauacgaauauaccagaaagaaaaagagaucaacggcacacuccaccuugauguagacguaaccgccgaauuucucaagaccgaagacgauuacgucgcgcuauucgacuggcuaaauucuagaaaagaaauagaacagaaaaccuuccuaaaauaccccaaauucgggcuaaagaaggaaauauccaacuacagauggaacuacguagaagacaaacaauacccauguaacgaaacaagacaugccauccuaucaucacucgaaaaagccaacgucugcaucgacuuccugucaaacgaaaaagaagucgcgcucuggcacauacuguacaguguaagcgacaagcaagaaaucgagaaagcacuccguacguucgcugcgaaaaacggccucgacgagucauucgucgaggcuuuuaagaaauucccgcccuucaaaucggaauacggcgcguacucagccaaagccauaaagaaaaugcucccacuaaugcgaugcggcaaguacugggacgugucaucaaucgacgacacaacaaaagaaagaauaaagaaaauaguuacaggcgaguacgacgaacggauaucugucaaagugcgcgacaaagucaugaaccucagcgacaucuccugcuucagaaggcuaccccuauggcuagcguguuauaucguguauaaucgccacucagaagacaaagaagcggugaaaugggaaagcccagccgauauagacgcauaucuagcauccuucaaacaacacucacugcguaacccaauagucgagcaagugauaacagaaacccuccgcguaguacgggacaucuggaaacaggucggacgcauagacgaaauacacauugaacuaggacgagaaaugaaaaacccggccgacaaacgcaaacguaugacggcacaaauuuuggagaacgagaacgccaaccuccgaauaaaagcacuacuagccgaguucaugaacccggaguacgagaucgaaaacguuagaccauacuccccgagccagcaagaaauccuacgcauauacgaagacacaguccuccacgcggaagaccagcuaccagaagaaauagacgcaaucuuaaagaaauucaauagcucuaaagucccaacgaaaagcgaguuccucagguacaaacuuuggcuagaacaaaaauaccguuccccauacaccggagaacugauaccgcucggcaaacucuucacagcggcuuacgaaaucgaacacgucauaccccaauccagguacuucgacgacaguuuuuccaauaagguuaucugcgaaagcgccguaaacaaguugaaagacaaccagcucggcuacgaguucaucaagaaccaccacggacaaaaagucgaaguuggguucgggaaauccguugagauauucucgguggacuccuacgagagauucgucaaggagcaauacgccaaaagcgccgucaaaaugaagaaacuccucauggaugacauaccagaacaauucauagaacgccaacugaaugauagccgcuacaucaguaaggucaucaaaggccuccugucaaacauaguccgcgagaaaaacgacagcggcgaauaugagcccgaggcagugagcaaaaacaucgucgucugcaccgguucagucacagacaggcucaagcgagacuggggcaugaacgacguuuggaacucaaucguauacccgcgauucgaacgccucaauucgcuaacugacacacagagcuucggccacugggaaaacaagucggggaagaaaguauuccaaacagagcugccacucgaauaccaaaaaggguuuucaaagaaacgaaucgaccaccgccaccacgcaauggacgcgauaguaaucgcaugcgccacacgcaaccacguaaacuaccugucgaacgaaucagccagccgaaacgcaaaaauaagccgguacgaccuccagcgccuucuaugcgacaaaaacaggacugacgacaacgguaacuacaaaugggucauaaagaaaccaugggacacauuuacccaagacgcacgggaaguccuaucgaaaauaguagucagccucaaacagaaccugcgcauaauaaacaaaacaaccaacguauaucgacaucuugacgccaccggaaaccgcguguacgaaaaacagaaaaccggagacuccugggccauacggaaaccaaugcauaaagacacugucuucggagcaguuaacuuacgcaaaguaaagguaguaagacugagcgucgcccucgacaccccggcaaugauagucgacaagagagucaaaaacaaaguguucgagcugcugagcuacaaauacgacaaaaagcgcaucgagaaauauuucaaagaaaacgcauuucuauggaaagaacuagaccuugccaagguggcggucuacuauuuuacagaggccacgacggaaccgcuagucgcaguccgcaaaccacucgauucgaccuucaacgaaaagaagaucaaagaauccgucacagacacaggcauccagaagauacuacucaaucaucuaugcaccaaggaaggcaagccagaccuagcauuuuccgccgaaggcaucgaagagaugaaccgaaaucuccuacagcucaacaacggaaaaucacaccaaccgaucuacaaaguccggguguacgagccccgcgggaacaaguucagcgucgggguguuggguaacaaaggaacgaaaugggucgaggccgcgaagggaacgaaccucuucuucgcuauauacaucaccgaagacgguaaacgaacauaugagacaauaccccucaacgugguaaucgagcgcgaaaaacagggccucguccccgucccggacaggaacaagaaaggagacaagcuccucuucugguuaagccccaacgaucugguauacuugcccaccgaggaagagagggaguucggacggaucaaugaacccauugaccggggccgcauauacaaaauggucucaugcacaggcaaugaaggccacuucauaccggccaacgucgccaauccaaucgugccaguaauagaacuaggaagcaauaacaaggcccaacgcgcuuggaccaacgaaaugauaaaggacaucugcaucccuaucaaagucgaccgccucggccacaucaucgaagucaaauacaggaucgaugaauga

SEQ ID NO: 6906 - RNA, 4530 nt, Artificial Sequence
  Cas9 variant
augaagaaaauccuaggccuggacuuaggaaccaacagcgucggaugggcagucauuaacagcguagucaacgaugaaggaaaggaacagcuagucaacauaagcucgugcggaagccgcaucauaccaauggacgccgcgacccucggcgacuucgacaaaggcaacagcaagagcccgguggcugagagaacaagguugcgcggcgugcgccgacucuuagaacgaagccuccucaggagagagcgacugcacagaguccuguccgugaugggauuccucccagaacacuacgcagcucagcuagaccgauacggaaaauuccugccugaaacagagccgaaacuagcgugguauaaggacgaaaccggaaaauacagauuccuauuucaggacagcuucaacgaaaugcuugaagacuuucacgaacaccaccccgagcuaguugccgaaggaaagaaaauccacuacgauuggacaaucuauuaccuaagaaagaaagcacuuucucagaaaaucacgaaagaggaacucgcuuggauacuccuaaacuucaaccaaaaacgaggauacuaucaacuccgaggagaggaggagcaagaggacaacaagaaaucagucgaauacuacgcacucaaaguggucgcgguagaagacuccggagaucgaaaagguaaagacaucugguacaacguaaaacuagaaaacggcuggguguaccgccgcgccagcggcguuccacuagacugggucgggaaagucaaagaguucauagucaccacugaccuagacgaaaagggcaauccaaagaaagacaaagacggaaacgucaaacgcuccuucagagccccgaaagaagacgacugggggcuacucaagaccagaacucaagcccaaaucgacgaaucgggccaaacagucggaacuuacaucuacgagagccuacucagaaugcccgaccagaaaauccgagggaaacuggucaggaccauagagcggaaauacuacaaagacgagcuccggaagauccucaucaaacaaagcgaauuucacacggcacuccaagaccacaacuugcucuuggccugcaucgaagaacuguaccccaacaacgaagcccaccggcgcuugcucagcaccagcgacuucaccuauuuccuaguggaggacauucuguucuaccaacggccccuaaaaucccaaaaaggacaaaucgacgacugccccuacgaaucccacgucuaccgcgauaagaaggacggcuccuugcagcaugucccacuaaaaugcguauccaagagccauccccucuuccaggaguuccggcuguggcauuuccugucauuccuccggaucuaucagagagaacgcaugaucgacggcagccugaaacuagacguagacgucaccaaugaguuccuucaaaacgaagacgacuacguaaaacuauucgacuggcuuaacgaaagaaaggaaaucgaccagaaaaccauccuggcguacaaacccuucggauuaaagaaaaacgaacaaucgaaguacagguggaacuacguggaggacaaaucauacccaugcaauuccaccagagccgauaugauauuccggcuauccaaagccggggucccggaggaguuccugacacgcgaaaaggaggaggcucuauggcacauacuauacagcauaucugauaagaaagaacucaccaaagcccuaggcacuuuugccgagaaaaacgggcugaacgagacguucguagagaucuucucaaaaaugccaccguucgaauccgacuacgcagcuuauucccugaaagcaauccgcaaacuacuagcacuaaugcgaauggguaaauacugggacgaacaagcaaucgacgaacacacgcgaagccgcauagaaaagauccucacgggcgaguacgacgaaaccauacgaacacgaguaagagaaaaagccaugcaccugaccgacaucagcagcuuccgaggacuaccacuauggcucgcaugcuacgucgucuacgaccgacacuccgaagccaaagagcuagucaagugggagacccccgacgacauagaccacuuccugcgaaaauucaaacaacacucccuacgaaacccaaucguggaacaaaucauaauggaaacgcuccgcaccguccgcgacaucuggaaacaggaaggcaaaauagacgaaauucacguugaacugggccgcgaaaugaagaauccggcaaaagaacgagcaagaauaacagcucaaguucuugaaaacgaaaacaccaaucucagaauaaaggcgcuccuugcggaguucaugaaucccgaguucgaaaucgaaaacgugcgcccauacucuccagcgcaacaagaaauauuacgcauauaugaagaaggaguccugagcgggguggccgagaaggaccuccccgacgacaucgcuucgauacugaagaaauucagagagaacgacguaaagaaacggccaaccacaagcgaaguucuaagauauaaacuguggcuagaacaacgauacaggagcccauacacaggccgcauaauaccccucgguaaacucuucacccccgcguacgaaaucgaacaugugaucccacaaagccgauacuucgaugacagcuucacaaacaaagugauaugcgaguccgccgucaacaaacucaaagacaacugccucggauaugaguucguaaagaaacauagcggcgaaaaaguagaacucggaaacggagaaacagccacuaucuucuccguagaagaauacgagcgcuucguaaaagacagcuauuucaacaacagcaagaaaaucaagaaacuacuacuggaggacauaccggauaacuucaucgaacgucaauuaaacgacagcagauauaucagcaaagucgucaaaagccuacugucaaacauagucugcgaagagggggaacaagagggcaugagcaaaaacgucaucguaugcacuggcgguguaacggaccggcucaagaaagacuggggcguccaggacgucuggaaccggauaauccucccccguuuccugcgccucaauaaaaugacagaccguaccgacuucacagccgugagcacaaacggacaucuacuaccagcggugccucuucaucugcagaaaggcuucaauaagaaaagaaucgaccaccgccaccacgccauggacgcaaucgucauagccugcgcaggacgcaacaucgucaacuaccucaacaacgccagcgccagaaaaggauccgagaucagccgcuacgaucuacaacaccuauuaugcgauaaagucaagacagacgcgaacggcaacuacaaauggauucuccgaaaaccaugggagaccuucacccaggaccucuacgcggcgcuuaccaacauagucguaucauucaaacaaaaccugcgagugauaaaccgcacuacaaaucacuaccaacacuauaaugaagacggagagaagaagaugauuccccagacgaagggagaucgccuggccaucaggaaaccaaugcauaaagacaccgucuacggcgaaguaaaccugcgcaaggagaaaacccugccccucaaggacgugguuaaaaaccccuccgcgguaguagacaagucacucaagaauaaacuguaugaauuacucaaaagccaguacgacuuaaaagcgauaacaaaguacuucgaaacacaccaggacgugugggcagacgugaaccucaagaaaauaaagguauacuacuucaccaaagaaacuaaugaacgcuuuuucgccacacggaaaucacucgauaguagcuucagccagaaaaagauugaagaagagguaaccgacacaggaauacagaaaauacuacuuaggcaccuacaacaaaauggcaacaacccugacauagcguucucgcccgacggaguggaacgaaugaaccaaaauaugacaauacugaacgauggaaaauggcaucaacccauauauaaggugcgcaccuacgaaaaagccgacaaguucgcggucggcgaaaaaggcaacaaagugaagaaguuuguugaggccgcgaaggggacaaacuuauuuuucgcgguauaugaaucuauccaagaagacgaagcaaccggaaagcaaguccgcaagcgcaccuucgcaacgaucccccucaaugaaguuaucaaacgcaaaaagcagggacugcccgcagcaccugaggacuccaaaggcaaccugccgaucuucguccugagccccaacgaccucguguaucugccgacagaagaagaacgcaacucuggaaaaaucauccaaccacucgacagagaacggaucuacaagaugguauccugcacagaaggagagugccauugcauccccgaauacguggcaaacccaauacuucaaaccaucgagcuagggagcaacaacaaagcccagcgcgccuggucuggcgaaaugauaaaggagaucugcguccccgucaaagucgaccgcuugggcaacgucagccuuauaaaaaucuga

SEQ ID NO: 6907 - RNA, 4530 nt, Artificial Sequence
  Cas9 variant
augaaaaccauauuaggacuggaccuggguacaaauagcguaggcugggccgugauaaacuccgucaucaaggaacaagccgaaagaaucuggauagaaaccgccggcucccgaaucauccccauggacgcugccgugcuuggcgauuucgacaagggcaacagcaucucacagacuucagagcgcacccgccugcgaggagcacggcgacuccgcgaacgccagcuacugagaagagaaagacuccauaaagugcucaacauucucggauuccuucccaaucacuaccuggaguacaucgacuucgaaaaacaccccggcaaauuccuggcggaugcggagccgaaacucgcuuggguaaaagacgagcaaggcaaauacaccuuucuuuuccaggcagccuucgaugagaugcuugccgacuucgccauccaucaacccucacucgucaguggcgacaagaaaauacccuaugacuggacaaucuacuaucugaggaagaaagccuugacagaaaugaucagcaaagaggagcuagcauggauccuacucaauuucaaccaaaaacggggauacuaccaacuacgcggugaagaggaagaagacaacgccggcaaaagcguugaauuuuacgcacugaagguacuuacggucgaagccacagacgagaagaagggcagagacguaugguacaacguucaucucgaaaacggauggauauaccgaagaagcagcuccgugccccuagacugggaaggacagguuaaagaguucaucgucacuacagaccucaaccccgacggcacaccaaaacuagacaaauacggggaagucaagcgaucguuccgcgccccaaaagaggacgacuggaugcuuaucaaaaagcgcacagaagcugacaucgcaaacacccauaaaacggugggcgccuacaucuacgacacacuacuacaaaagccacaacagaaaauaauagguaaacucgucaaaacggucgagaggaagcuauaccgagacgaacucagccuaauccuccaaaaacaaugcgccuuccaugcugaacuacaagaccgcgcucuauaugcgcgaugcgucgaagcccuauacccaagcaaugaagugcgaagaaagaacaucgcaaaccgagacuucgucuaccuccugauggacgacauucuguucuaccaaaggccacuaaaaacaaagaaaucgcucauagccaacugccccuacgaggaaaacgaauacguugacagagagacaggugaaauaaagaaagcaccccugaaaugcaucgcaaaaucacacccccuauuccaagaguuucgccuauggaacuuccucucaaacaucagaaucuaucagaaagaaaaggaaaucaacgggacucuucaccucgauguagacguaacagccgaguuccuuaaaaccgaagacgacuauguugcccuauucgacuggcugaauagccgaaaggaaaucgaacaaaagaccuuucucaaguacccuaaauucggccucaagaaagagaucagcaacuaccgguggaacuacgucgaggauaaacaauacccuuguaacgagacgagacaugcgauacucagcucauuggaaaaggcaaauguauguaucgacuuccuaaguaacgagaaagaggucgcucucuggcacauucuauacagcguaucugacaagcaagagaucgagaaagcccugcgaaccuucgccgccaaaaacggucuagacgagagcuucguugaggccuucaagaaauuucccccauucaaaagugaauacggagcuuacucggccaaagccaucaagaaaaugcugccacugaugagaugcgggaaauacugggauguguccagcaucgacgacacaaccaaagaacgaauaaagaaaaucgucacaggcgaauacgacgaaagaauagcggucaaaguccgagacaaagucaugaaccuuagcgacaucagcugcuuccgacgacuuccgcucuggcucgccugcuauaucguauacaacaggcacuccgaggacaaagaagccgucaaaugggagucaccggccgacaucgacgccuacuuagccuccuucaaacagcacucguuaaggaacccuauuguagaacagguaauaacagaaacguugcgcgucgucagagauauauggaaacaaguugggcggaucgacgagauacacauagaacucgguagagagaugaaaaaccccgccgacaaacgcaaacgcaugaccgcgcaaauccuagaaaacgagaacgccaaccugcgcauuaaagcccugcuggcugaauuuaugaaccccgaguacgagauugaaaacgucaggccguacuccccaagucagcaagaaauacucaggauauacgaggacacaguacuccaugcggaagaccaacuacccgaagaaauugacgcgauucuaaagaaauucaacucgucgaaagucccgacaaaaucagaauuucuacgguauaaacuauggcuugaacaaaaauauagaagcccauacacaggagaacugauaccgcuaggaaaacucuucaccgcagccuacgagauagaacaugucauaccccagagcagauacuucgaugauagcuucuccaacaaagugauaugcgaaucggcggucaacaaacugaaggacaaccagcugggauacgaguucaucaagaaccaucacggacaaaaagucgaaguaggauucggcaaaucaguagaaaucuuuuccgucgacaguuacgaaagauucgucaaggaacaauacgcaaaauccgcagucaaaaugaagaaacuacucauggacgacaucccagaacaguuuaucgaacgacaacuuaacgacagucgcuacaucagcaaagucauuaaaggacuacucucgaacaucgucagagagaaaaacgacagcggagaauacgaacccgaagcgguguccaaaaacauagucguuugcacaggaagcgucacagacagacugaaaagagacuggggcaugaacgacgucuggaacaguauaguauacccccgcuucgaaaggcugaacucacugacugacacgcaaaguuuuggccacugggaaaacaagagcggcaagaaaguauuccaaacagaauuaccgcucgaauaccaaaaaggcuucaguaagaaacgcauagaccaccggcaucacgccauggacgccaucguaaucgcaugcgcgacccggaaccacguaaacuaucuaaguaacgaaucagccucccggaacgccaaaaucuccagguacgaccuucaaaggcuccucugcgacaagaaccgaaccgacgacaacgggaacuacaaauggguaauaaagaaacccugggacacauucacccaagacgcccgcgaaguacucuccaaaauaguggucagccuaaaacagaaucuacgcaucauaaacaaaacaaccaaugucuaccggcacuucgacgcaaccguaaaccgcguauacgaaaaacaaaagacgggagacucaugggccauucggaaaccaaugcacaaagacaccguguuuggcgcggugaaucuccguaaagucaaaguaguucgccuaagcguggcgcucgacacgccggccaugauagucgacaaacgcgucaaaaacaaagucuuugaacuccucaguuacaaauacgacaaaaagcggauagaaaaauauuucaaagaaaacgcauuccuguggaaagaacucgaccucgccaaagucgccgucuacuauuucaccgaggcgacaaccgagccccucgucgcuguaagaaagccacuggacucgacauucaacgaaaagaagaucaaggaaaguguaaccgacacuggcauacaaaagauauuacugaaccaccuaugcacgaaagaggguaaaccggacuuagccuucucggcagaaggcauagaagagaugaaccgcaaccuacuucaacuuaacaacggcaagagccaccagcccauauacaaaguacgagucuacgaaccacgcggcaacaaguuuagcguagggguacuaggcaacaaaggcacgaaauggguggaggccgcaaagggcacgaaccuauucuucgcaaucuacauaacggaagacggaaaacgcacauaugaaaccauaccccucaacguugucaucgaacgagagaagcagggacuuguccccgucccggacaggaacgaaaaaggcgacaaguuacuguucuggcugagcccgaacgaccuaguguaccuccccaccgaggaagaaagagaguucggacgcauaaacgaacccaucgaccgaggacguauauacaaaauggucuccugcacaggcaacgaggggcacuucauucccgcuaacguggcaaauccgauaguccccgugaucgaacucgguucaaacaacaaagcccagcgagcuuggaccaacgagaugaucaaggauauaugcauccccaucaaggucgaccgccuaggacacauaauagaagugaaauaccgaaucgacgaguga

SEQ ID NO: 6908 - RNA, 4530 nt, Artificial Sequence
  Cas9 variant
augaagaaaacccuuggacucgaucuaggcacaaacuccauaggaugggccguaauaaacucaaauaucgacuccgaaggcaaagaaaaacugguaggcauaagcagcugcggcucgagaaucauccccauggacgccacgacccugggcgauuuuggcaagggcaacaccaaaagcccgguagcagaaagaacacgucucagagggauacggcgccuacucgaacgaagccugcuacgacgcgagcgccugcaccgcguacuaucggugauggguuuccuuccagagcacuacgccagccaacuagacagauacggcaaguuccuacccgagacugagccaaaacucgcaugguacaaggacgacagcggccgguaccaauuccuauuccaaaaaucuuuccacgagaugcuagaggauuucagacaacaccagcccgaauuagucgccggcgagaaaaagauucccuacgacuggaccaucuacuaccuacggaagaaagcccuuucgcaagagauaaccaaggaggaacucgccuggauccuucuaaacuucaaccagaaaagaggauacuaccagcuacgcggggaagaagaacaggaagaaaacaacaaaucgguggaauaccacgcccuaaaagucguauccgucgaagacucuggagagcggaagggcaaagacaucugguacaauguaacacucgaaaacgggugggucuaccggagggcaucgaauaucccccuggacuggacuggaaaagucaaggaguucgugguuacgacggaacuagacgacgccggcaaccccaagaaagacaaagaagggaaugugaagcgcagcuuccgagcuccgaaggaagacgacuggggucuucugaaaacacgcacccaagcacagauagacgaaucaggcaagacuguaggaacguacauauacgaaucacugcuaugcaugcccaaccagaaaauccgagggaaacucgugcguaccaucgaaagaaaauacuacaaggacgaacuccggcaaauccucgucaaacaaagcgaguuccacgcagcacugcaagaucauaaccuccuacuaucgugcaucgaagaacuauaucccaacaaugaggcucaccggaggcuacucagcgcaagcucauucauauacuuccucaucgaagacauucuauuuuaccaaaggccacuaaagagccaaaaggggcucaucgauaauugccccuaugaaagucacaucuauaaagacaagaaagacggaucacuacaccaugucccccuuaagugugucagcaaaucccauccccuuuuccaagaguuuaggcucuggcaauuccuguccaaccugcgaaucuaccaaagagaacgcaugauggacggaucccuaaaauuagauguagacgucacccgcgaguucuuacccagcgaagaagacuacgugaaacucuucgacuggcugaaugaaaggaaagagaucagccagaaauuccuacuagcauacaaacccuucgggcucaagaaaaacgaacaggcuaauuaccgauggaacuacguugaagauaaguccuacccaugcaacgaaacacgagcggaaaucaaaucccgauugucgaaagcaggagucccagaggaguuccuaacggaagaaaaagaagaggcccucuggcacauccuguacucaauaagcgacaagaaagaacugaccaaagcacucgggacauucgcagcgaaaaauugucucaacgaaucauucguagagguauucgccaaaaucccuccguucgaaagcaacuacgccgccuacagccuaaaagcgauccgcaaacuacuagcccuaaugcggaugggaaaguacuggaacgagcaagccaucgaucgccaaacccgcgauaggauagagaaaauacucaccggcgaauacgacgaaacaauaagauccaggguccgcgaaaaagccaugcuccugaccgacaucagcucauucaggggccucccauuauggcucgcgugcuacauagucuacgacagacauucagaaucuaaggaacucguaaaaugggaaacuccggcagacaucgaccacuuccuauccaaauucaagcaaaacucccuucgcaacccaauaguugaacaagucaucaccgagucacuuagaacgguacgcgacauauggaaacaggaagggaagauagacgagauacauguagaacucgggagggaaaugaaaaaccccgcgaaagaacgagcgcgcaucaccgcgcaagugcaggaaaacgagaacaccaaccucagaaucaaagcccuccuagcugaguucaugaacccagaguucgaaaucgagaacguacaccccuauucgccggggcagcaggaaauccuccgcaucuacgaggacggcguccugucaggcauugccgaaaaagaccucccagacgacauaaccgcaauccucaagaaauuccgagaaaacgacgugaagaaacggccgaccaccagcgaaguacuccgcuacaaacuauggcucgaacagcgcuaccggagcccauauaccggacgcgucaucccccucggcaaauuauucaccccagccuacgaaauagagcacguuaucccucagagccgauacuuugaugacagcaucagcaauaaagucaucugcgaauccgcugucaacaagcucaaagacaacugccuuggauacgaguucaucaaaaagcacagcggggaaaugguagaacuuggaaacggagagaccguacccguauuuagcgucgaagaauaugagcgauuuguaaaagaauccuauuucgggaacucgaaaaagaugaagaaacuucuccuagaagacauaccagacuccuucauagagcgccaacucaaugacagucgguacaucucccgcguagucacgagucuccucagcaaccucgucugcgaggaaggggaacaagacgguuuaagcaaaaacguaaucgucugcacgggcgggaucaccgacagacuaaagaaagauuggggcguccaggaggucuggaacagaaucaucuuaccccgauuccuacgccugaacgaaauaaccgggcgaaccgauuucacgucaaccagugugaacggucaucugcuuccugcacuaccccuauaccuccagaaaggcuuuaacaagaaacgaauagaccaccgccaccacgcaauggacgccauaguuaucgccugcgcgaacaggaacauugucaacuaccucaacaacucgucagcacguaaaaauucagaaaucagcagauacgaucugcagcguuugcucugugagaaagucaaaacagacgccaacgggaauuacaaguggauacugcgcaaaccuugggaaacauucacacaagauguguacgccgcacucacgaacaucguaguguccuucaaacaaaaccucagggucauuaacagaaccacaaauuauuaccaacacuacaacgaagccggagagaaacgaaugaucccccagacgaagggcgacagaugggcgaucagaaagccgaugcacaaagacacgguuuacggggaagucaaucuccggaaggagaagacccugccccuccgcgacguggucaagaauccguccauagugguugacaaaucccucaaaaacaagcuauacgaacuccucaagagccaauacgacuugaaagccaucgcgaaauauuucgagacgcaccaggacguaugggcagaugugaaccugaagaagauaaaggucuacuauuuuacuaaagagaccaaugagcgauucuucgccacgcggaaaucacuagaccccucauucgaucagaaaaagaucgaggaagaaguaacagacacaggaguccagaagauacuauugcaccaccuccaacagaauaacaacgacccggauauggccuucuccccagacggcaucgaccgcaugaaccaaaacaugaccauacugaacgacggcaaguggcaccaacccauauacaagguacguaccuacgaaaaagcagauaaauucgccguaggcgagagcggcaauaaagccaagaaauucgucgaggccgcuaaaggaacaaaccuauucuucgcggucuacgaauccguucaggaggaugaagccaucggaaaacaagucugcaaacgaacguucgccaccaucccacucaacgaggucaucaaacgcaagaaacaaggccuaccggcagcacccgaagaucucaacgguaaucuaccaaaauucguacuaagcccgaacgaucuagucuaccuacccacagaagaggagcgaaacucaagcagaaucauacagccccuagaccgcgaaaggauauacaaaauggucagcuccagcggcagccagugcuucuucauaaaaguguucguagcaaauucaaucugggacaaaaacgaauacaguucacuaaacaaaauggagcgcgcaauuaccaacgaaaugaucaaagaaaucugcguuccaauaaaaauagaucgccuggggaacguuagcuugauccaaaucuga

SEQ ID NO: 6909 - RNA, 4533 nt, Artificial Sequence
  Cas9 variant
augaaaagaauccuaggacuggaccuuggaacaaacucaauaggaugggccuuaguagacagcgaagaacaaagaauacuaggcaugggcuccagaauuauacccauggaccaagggguccucgacacguucagcggcggaaacccgguagagacccaaacagcagcccgaacaguguaccgcgggacacggaggcuccgagaacgggcccuacugcgacgcgagcgacugaucagaguccuuaacaugaugaaauuccuaccugaacauuacgcgucacaaaucgacuucgaaaaacgguuaggccaauucuucgacgagaaagagccaaaacucgcauggaaacaaaacgacgaaggccgauucgaguucaucuuccaacagagcuucaacgaaaugaucgaagaguucaagaacaaggguguaguacgugaagacaaaaagauccccuacgacuggacgaucuacuaccuccggaagaaagcccuaagccaagagauagaaaaagaggaacuagccuggauccuccucaauuuuaaucaaaaacgagguuacuaucagcuacgcggcgaggaggaggaagagaaccccaacaagcucgucgaauacuauucccucaaaaucguagacguuauagcugacgaaaaaccgaacucuaaaucagacaucugguauucccuacaccucgaaaacgguuggauauaccgacggagcagcaaaaucccccucuucggauggaaagauaagacccgcgacuuuaucgugaccaccgaccugaacgacgacgggacagugaagaaagauaaagagggcauagaaaaacgcagcuuccgagcccccucagaaaacgacuggguccuguugaaaaagaaaacugagagcgacauagagaaaucccacaaaacggucggcgcuuacguuuacgaaacacuacuccaaaaccccaugcaaaaaguccggggaaaacuuguccgaacgauagaacgaaaauucuacaaggacgaacucaagcaaauccuagaaaaacagcgcgaguuccaccccgaacuucgugacgaggaccuguacaaugauugcgugagagagcucuacaggagcaacgaaaccuaccaguucauccugagcaaaagagacuucguccaccuguuccuugacgacaucuuauucuaccaacgcccgcuccgaucccaaaaaucagcuauaggcgacugcauccucgaguucaaaacguauaaagacaaggauggcaacaacaucaaggaauaccuuaaaguaauaucaaagucaaacccauuguaucaggaguuccgaaucuggcaauggcucuauaacuugaaaaucuaccguaaggaagacgacgaagacguaacacuccaguuuaucgccaacaucgaggacaaagaacagcuuuucgauuuccuaagcaaccgcaaguccaucgagcaaaagccacuacucgaauaccuaauaaaagccaaagggcucaagaaacaggucaaaacagaggcuuacagauggaacuacgucgaagacaaaaucuaccccugcuccgagaccaaaacgaugaucagcacgcgacuagccaaaguagaaaacauccccgacaacuucuucaccaaagaaauagaacaaaagcucuggcacaucaucuacagcguaacggauaagaacgaguucgaaaaggcgcugcgcaccuucgcaaagaaauacgaccucgacaucgcuuccuucguagacaacuucaagaaaaucccaccguucaaaaacgaauacggcucuuuuagcgagaaagcgauaaagaagcuacucccucuuaugcgccugggaaaauacuggaaauggaacgacauagacaacaacacccagaaccgcauaucgaaaaucauuaccggcgaauacgacgaagaaaucaaggacaucguccgagaaaagagcaucgcgcucacaaacgagaacgacuuccaagggcugcaacuguggcuagcccaauaccuagucuacggccgccacuccgaagcugauauagcggggaaauggcacagcguggcugaccucgagaaguaucuaaacgaguucaagcagcacucccuucgcaauccgaucguggagcaaauaaucacagaaacccuaagaguaguccgcgacauuuggcguaaguauggacagggagcggaaaacuucuucagcgaaauccacguagaacucggacgggauaugaaaaacaccgccgacgaacgcaagaaaauaguaaacgucgucacugagaacgaaaacacaaaccuacggauuaaagcccuccucauggaacucaaaaacaauagcgacggaaaacuagagguagaaaaugugcgccccuacagccccacccagcaagauauauugaaaauuuacgaggaguacgcgauauccacagggcuagacaacgagaaagacgaaaaagucaaagaagacaucaaaaagauaagccgcgucgcccaacccacuaccacagagcuacagcguuacaaacucuggcucgagcagaaauacugcucuccguauaccgggaagguuauaccccuaggcaaacuauucaccgaggaauaccagauagaacacauaauaccuaagagccgcuacuacgacgacuccuucucgaacaaagucauaugcgaggcggccgucaacaaacuuaaagacaagugccuaggccuagaguucaucaaaaacuaccacgggcaaauagucgaaaccggcuucggacagaaaguaaccauuuucgacgaagaagccuaccaaaacuucguaaagcaacacuacgccuacaaccacagcaagcguacgaaguugcuacuagaagagauaccggaaaagaugaucgaaaggcagaugaacgacacgagauacaucucgaaauucgugcuaccacuccugagcaaccuaguaagggcaaaggaaaacgacaacgggguaaacucgaaaaacguccucccagugaacggcaagaucacaacuaugcucaagcaagacuggggacuaaacgacguguggaaugaucuaauacucccacgauucgugcggaugaacgaacuggcuaaaacgaucgcguucacauccuggaacgaacaacaccaaaaguaccuccccacuguccccuuggagcucagcaaaggauuccagaagaaacgaauagaccaccggcaccacgccauggaugcucucguaauagcaugcgcuacccgagaccaugucaaucuccucaacaacaagcaugccaacaccgacacgauacgguacgaccugcaaaggaaacucaggcuuuucgagaggguaacguacaucgacccgcaaaccaaaaacaacgucacaaaagacauaccgaaagaguucaaaaagccuugggacaauuucaccguagacgcgagaaacgaacuagagaaaauuauagucagcuucaagcaaaaucuacgcaucaucaauaaggcuaccaacaucuacaccaaguacgaaaauggcaaaaagaucaaagucggccaaaagggacucaacugggcaauucgcaagccgcuacacaaagaaaccguauucgccaaaguaagucuacgcaaaagaaaaaccgugcgcuuaucagaagcacucaaggacuggaaaaagaucguggacaagaaacuuaaacaagaaauaaagcggcuuaccugccaauacggcaaguucgacguagacaccauacuacguuacuucaaagaccgcaaauaccaguucggagaaguagacguaucgaaggucaaaauguacuacuucgacgaagaaaacgcagccguaaggaagaacguggauaccucauucacagagaaauucauccaaggguccgucacggacaccgguauccagaaaauccuccuaaaucaccucgaagccaaagggaacaagguagaaauagcauucuccccugaaggaaucgaggagaugaacaaaaacauuauccaacucaacgaagggaagcuccaccucccgaucuuuaaaguuaggguauacgagacgaucggcaacaaauucucaguggguguaaagggcaacaagaaagauaaauacguggaagcggccaaagggacuaaccucuuuuucgcgauauacguggacgagaacggcauaagaucauaugaaacaaucccccuaaacaucguaaucgaacgacuaaagcaagggcuaagcgucguuccggaaaagaaccgcaaagaacacagccuacuauucuaccugaguccuaacgaccugguauacguaccaauagaggacgaacgcgagaauauacacgccgugaaccuagaccaacucaacaacgaacaaagaaaacgcaucuauaaaaugguauccugcacagggucggaaugccacuucguacccuauuauguagccagccccauugugaauaagguggaauacagcucgcuaaauaaaaucgggcguagccucacuggcgagaugaucaaggacguaugcaucaaacuaaaggucgaucgccugggcaauaucaaggguaucuccggucucuga

SEQ ID NO: 6910 - RNA, 4533 nt, Artificial Sequence
  Cas9 variant
augaagagaauacucggacuugaccuaggcaccaauaguaucggcugggcucuggucgacucugaagaacaaaggauccucggcaugggaucgcgcaucauccccauggaccaggggguacucgacacauucuccggcgggaaccccguagagacccagaccgccgcacgcaccgccuaccggggcacgcgaagacuacgagaaagagcccuccuuagacgagagcgucuaaucaggguccuaaacaugaugaaauuccuuccggaacacuacgccagucaaaucgacuucgagaagcggcugggccaguucuucgaugaaaaagaaccgaagcuagccuggaaacagaacgacgagggcagauucgaguucaucuuccagcaaaguuuuaacgaaaugauagaagaguucaaaaauaagggagucguucgagaggacaagaagauucccuacgacuggaccaucuacuacuugagaaagaaagcccuaucccaggagauagagaaggaagaacuggcguggauccuccuaaacuucaaccagaaacggggcuauuaucagcuccgcggcgaggaagaagaggaaaaucccaacaaacucgucgaauauuauagccugaaaauaguggacgugauagcggacgaaaagcccaacucgaaaggcgacaucugguacagccuccacuuagagaacggguggauauaccgacgaagcagcaaaauaccacucuucggauggaaagacaaaacgcgcgacuuuaucgugacaacugaucucaacgacgacggaaccgucaagaaagacaaagaaggaauugagaaaaggucauuccgagccccguccgaaaacgacuggguccuguuaaagaagaaaacggaauccgacauugaaaagagccacaagacagucggggcauacguguaugaaacccugcuacaaaaccccaugcaaaaaguucgcggaaagcuagugcgcaccaucgagcgcaaauucuauaaagacgaacuaaaacaaauccuagaaaaacagagggaguuccauccggaacuacgcgacgaagaccucuacaacgacuguguaagagagcuguaccgauccaacgaaaccuaccaauucauccucucgaaacgcgacuucguacaccucuuccucgacgauauacuauucuaccaacgcccgcuacggagccaaaaaucagccauuggcgacugcauacucgaguucaagacauacaaagacaaagacggaaacaacaucaaggaguaccugaaagugaucaguaaaagcaacccccucuaccaagaguucaggauauggcaguggcuguacaaucucaagauauaccggaaggaagacgacgaggacgucacacuccaauucaucgccaacaucgaggacaaggaacaacucuucgacuuccuaucgaacagaaaaucgaucgaacaaaaaccguuacucgaauaccuaauaaaggccaaaggucucaaaaagcaagucaaaaccgaagccuaccgauggaacuacgucgaagacaagaucuacccaugcucagaaacuaaaacaaugaucucaacacgccucgccaaggucgagaacauaccagacaacuucuucacuaaggagauagagcagaaacucuggcacauaauauacagcgucacagacaagaacgaguucgaaaaagcccugcgcacguucgcgaagaaauacgaucucgauauagcguccuucguagauaacuucaaaaagaucccacccuucaagaacgaguacggcucguucuccgaaaaagcaaucaagaaacugcucccgcuaaugcggcuuggcaaauacuggaaguggaacgauaucgauaacaacacccaaaaccgcauauccaaaauaaucacuggggaauacgacgaagaaauuaaagacaucguucgcgagaagucgaucgcucuaacaaacgagaacgacuuccaagggcuacaacuguggcucgcgcaguaccucgucuacggcagacauuccgaggcugacaucgccggaaaauggcacucgguagccgaccuagaaaaauaucugaacgaguucaaacaacacagccuuagaaacccuauaguagaacagauaaucacagaaacgcuucgcguagugcgcgacaucuggcgcaaguacgggcagggcgccgagaacuucuucagugagauccauguugagcucggccgggacaugaaaaacaccgccgacgagagaaagaaaauagucaacguaguaaccgaaaacgaaaauacgaaccuaaggaucaaggcgcuccucauggagcucaagaauaacucugacggcaagcucgagguggagaacgugcgcccuuacagccccacucaacaagauauccugaaaauauacgaagaguacgcaaucucuaccgggcucgacaacgaaaaggacgaaaaggucaaggaagacaucaaaaagauuagcagagucgcgcaaccgaccacgacugagcuucaacgcuauaagcucuggcuagagcaaaaguacugcagccccuacacaggcaaagucaucccccuuggaaaauuauucacggaagaguaccagaucgagcacaucauaccaaaaucgagauacuacgacgacuccuucucuaacaagguaauaugcgaggccgccgucaacaaacugaaagacaaaugcuuagggcuagaguucaucaaaaauuaccacggacagauaguagaaaccggguucggccaaaaagucacaauauuugaugaagaagcguaccagaacuucguaaaacaacacuacgccuacaaccgcagcaagcgcaccaagcugcuccuggaagagauacccgaaaagaugauagagcggcaaaugaacgacacgcgguacauuaguaaguucguccuaccccuucuaagcaaccuaguacgagccgaggagaacgacaaugggguaaacagcaagaacguccuaccagucaacggaaagauaaccacgaugcugaagcaagacugggggcuaaacgacgucuggaacgaccugauccugccgcgcuucguuagaaugaacgaacuagccaaaacaauugcuuucaccaguuggaacgagcaacaccaaaaauaccuuccgacggucccacuugaacucuccaagggauuccagaaaaagcggauagaccacaggcaccacgcgauggacgcgcucgucaucgcgugugcgacgcgcgaccacgugaaccuacucaacaacaaacacgcaaacaccgacacuauccgguacgaccuacagagaaaacuacgccuguucgagaggguaacauacauagacccccaaaccaaaaacaacgucacaaaagauauaccaaaagaauuuaagaaaccgugggauaacuuuaccguagacgccagaaacgagcucgagaaaauuauugucagcuucaaacagaaccugcggauaaucaacaaagccacgaacauauacacgaaguaugaaaacggaaagaaaauaaagguggggcagaaaggauuaaacugggccauacggaagccccugcacaaggagacgguguucgcgaaagucucccucaggaagaggaaaaccguccggcugagcgaggcacucaaagacuggaagaaaauaguggacaagaagcucaaacaagagaucaaacggcuaaccugccaauacgguaaauuugacguagauacaauacugcgguacuucaaagacaggaaauaccaauucggcgaggucgacgucucaaaagugaaaauguacuacuucgacgaagaaaacgcagccguacggaagaacguagauaccagcuucacagagaaguuuauccaggguaguguaaccgacacagggauccagaaaauacuucucaaccaccucgaggccaagggaaacaaggucgaaauagcuuucuccccggaagggaucgaagagaugaacaagaacaucauacaacugaacgaaggaaagcugcacuugccaauauucaaaguacgcguguacgagaccauaggaaacaaauucuccgucgggguaaagggaaacaagaaagacaaguacguggaagcagcgaaagggacuaaccuauucuuugcuaucuaugucgacgagaacgggauccgcucguacgaaacaaucccacugaacauugucaucgagcgguuaaaacaaggacuaagcgugguccccgagaaaaaucgaaaggaacacucgcugcuauuuuaccuuucaccaaacgaccucgucuaugugccuaucgaagaugagcgagaaaacauccacgccguaaaccuagaccaacucaacaacgaacaaaggaaaagaauauacaagauggugagcugcacaggcagugagugccacuucgucccguacuacguugcguccccaaucgugaauaaaguggaauacucgucccucaacaaaaucgggcgcucccugaccggcgagaugaucaaagacguauguaucaaauuaaagguugacagacucggcaauguaaaaggaauauccgggcuauga

SEQ ID NO: 6911 - RNA, 4536 nt, Artificial Sequence
  Cas9 variant
augaagaaaauacugggcuuggaccuaggcacaaacagcaucggcugggcaguaaucaacagcguugcugaugaaucggucgaaaagcgcaauauugagcucgccggcagccggaucaucccgauggacgccgcaguuuuaggcaacuucgacaauggggucaccaagagccaaacggccgagcgaaccucauacagguccaucaggagacuccgcgaacgacaacuucugagacgcgagcgacuacacaaagugcugcaaauccucggauuccugccagagcacuacguuaacgacauagacuucgagaaccacccaggaaagaucaaaaagaacacagaacccaaacucccauggcgcaaaaacagcaugggacaauucgaguuuauauuccaagcgagcuucgaggccaugcuaacagacuuugccacgcaccagccggucuucgucagcgaggggaagaaagugcacuacgacuggacccucuacuaccuccggaagaaagcgcucacugaggaaauaucaaaagaggaacuagcguggaucauccucaacuuuaaccagaaaagaggguacuaccaacuaaggggagaagaggaagaagaacaaucaaauaaacucgucgaguucuacgcucugagagugguaaaaguagaggccacggacgacaagaaaggaaaggacacaugguacaacguccaccucgagaacggauggaucuacagacgcacgucgaacaucccucucgauugggaaggcaaagucaaggaguucaucguaacuacagaccuuaacgaagacggaacacccaagcuagacaaauacggagaagucaagcggagcuuccgagccccgaaggaggacgacuggacucuaaucaaaaagaaaacagaaagcgacauagccaacucacauaaaacccuagggugcuacaucuacgacgcgcugcuacaaaacccgaaccagaaaauaaaaggcagguugguccgcacagucgagcggaaguucuacaaggaagaacuacgccugauccuagaaaaacaacuaaguuuccacccagaacuacaagaccgcgauuuauaccgcgccugcaucgacgcccuauacgugagcaacgaggcgcauaaaaacaauaucagcggacgggauuucguuuaucucuucauagaugacaucaucuucuaccagcgcccacucaaaacaaagaaaagccuaaucgauaauuguccauacgagaagaaccaauacauggaccgcgagacaggagaaguaaaacaggcacccaucaaauguauagcaaaaucgcacccccucuuccaggaguuccgccucuggcaauucaucuccaauauuaggauauaccagcgggaacgugucauggacgacggaaaauuggaaacagacguagauguuacgcccgacuucuuaaagacagaagacgauuauacaacccucuucgaauggcucaacgaucgcaaagaagucgaccagaaagcauuucucaaaaauccccaauuuggacuaaagaaaaccuucacagaauaucgcuggaauuacguggaagacaaaagcuaccccuguaacgaaacgagaaacgcgauccugaacggacugcaaaaagcaggggucagcgcggauuuccucagcagagaggucgaggaggcacucuggcacauauuauacucuguggaagacaaaauagagaucgagucggcccuccgcaaauucgcaagcaagcacgaccucgacgaccgcuucgccgacgucuucaagaaacuucccccguucagaaaagaguacggagccuacagcgcaaaagcgaucaagaaacucuugccgcuaaugcgaauggggaaauacugggagcuaagcaacauagacgacaagaccaaggagagaauagacaagaucauaacgggagagugggacgaaaacauacacaaccgagucagggaaaaagcgaucaagcuaagcgacauaacggauuucaaaggauugccccuguggcucuccugcuacgucguguacaaccgacacagcgaagcuagggcaaucgcaaaaugggaaucgccggaagacauagacagcuaucucagacuuuuucgccaacacucgcuacgcaacccgguggucgaacaaguaauaaccgagacccuacgcacagucagagacauauggaaaaggaucggacaaauagacgaaauccacguagagcucggccgagaaauaaagaacccagccgacaagcgcgcaaagaugaccgcgcagaucgucgagaacgagaacaccaaccuacggaucaaggcccuccuagcagaguucauuaauucagaauacgaaauagaaaauguacgacccuacuccccaggacagcaagaaauccuacgaaucuacgaggacaccguacucaacagugucgaggagaucccagaggacaucuccgccgucuugaaaaaguuccgggagagugaccugaagaaacgaccaacaaaaagcgaguuccuacgcuacaagcuauggcuggaacagaaauaccggagccccuacacaggggacaucaucccucuggggaaauuauuuacaagcgcuuacgaaauugaacacaucaucccgcaaucucgauauuucgacgacagcuucucgaacaaaguaaucugcgaggcagaagucaacaagcucaagucgaaugaacuaggcuacgaguucaucaaaaaccaucacggacaauacgucgaaauaggcuuuggcaaggugguccaaauauucagcauagaagcauacgaaaaauucgugaaggcaaacuauaguggaauaggcucaaaaaugaaacgcuuacucauggaugacaucccagaaacguucaucgaaaggcagcucaacgauagccgauacauuagcaaagucguaaaaagccuauuaagcaacauaguucgagaaaaagacaguaacggcgaauacgaacccgaggcaauaagcaaaaacgucauagucugcaccggcucagucacggaccggcucaaaagagacuggggugucaacgaugucuggaacucgaucauuuacccccgauucgagcgcuuaaacgagcuaaccggaucgcagcaguucggaugcugggagaacaaagaaggcaaacggguguuccaaaccgcgguaccacuagaaaugcagaaaggguucaguaagaaacgaaucgaccauaggcaccaugcaauggacgccauagucauagccugugcaauccgaaaccacaucaacuaccuaucuaacgaaucagcaagcaagaaagcaaaaauaaguaggaucgacuuacaaaggcuacuaugcacgaaaugccgaacagacgacaauggcaacuacaaauggaucguuaaaaagcccuggcccgcauucacccaagauaucagaaaggcgcuagaaaauauuacggugaguuucaagcaaaaccuacgggucauaaacaagaccacuaacuacuacguacacuuugacgagucgggcaaaaaggugcucgagaagcaaaucaacggagacagcugggcgauccguaagccgaugcacaaggacaccguauuuggcaagguaaaccuccaaaaaguaaaagaaguacgccuuucacuggcacuagacacccccaagaugaucgucgacaagaaauuaaaagaaaaaguccugcaacucuacucauacaaauacgacaagaaacggaucgacaaauauuuuaaagaaaacgccagccuauggaaagaccucaaccucuccaaaguggccguauacuacuucacaaaugacagcaccgagccacucguggcgguccggaaaccgcucgacaccagcuucaacgccaagaaaaucaaagaaucuguaacagacaccggcauacagaaaauccuacugaaccaucucucaaacaaccaggacaauccgaaccuggccuucagccccgaugguauagacgaaaugaacaggaaccugacaacgcugaacgacggcaaauaucaccagccaauauacaaaguaaggguaugugagccccaagggaacaaauucuccguagggacaagcgguaacaaaaccagcaaauauguggaagcggcgaaaggaacaaaccucuucuucgccgucuaccaaacagaagauggcaaaagaaacuacgaaaccauuccacuuaaugucgucauagaacgagaaaaacucgagugggccccaguacccgaaaacaacaacaacggagacaagcuacuguuuuggcucuccccgaacgaucucguauacguaccuaccgcagacgaacucaacaaugggaugcgccucgauaacauggacaaagggcggaucuacaaaaugauaaguugcagcgggccccaaugcuuuuucauaccccaaaacguauccaaccccaucauuccaguaauugaacucggcgucaacaacaaggccgagaaguccuggaacaacgaaaugaucaaaguaguaugcgucccaauccgcguggaccgccucggcugcaucacgcaaauaaacaaccagaaguga

SEQ ID NO: 6912 - RNA, 4539 nt, Artificial Sequence
  Cas9 variant
augaagaaaauccucggucuagaccuaggaacuaacucgaucgggugggcccucauagagaacuccuucaccgaaaaagaagguaaaaucaacgacaugggcguccgcauaauccccaugagcgccgacauccugggaaaauucgaugccggccaaagccacucacagacggcggaacgcacuggcuacagaggcacccgaagacucuaccaacgggauaaccuucgccgcgagcgacugcacagaguacuacauauccuaggauucuugccaaaacauuaugacgaacacaucgacuucgaaaaacgccuugggcaauucaaagaagggaaggaaauaaaacuaaacuaccgaugcaacgucgaaaacaagcacgaguucaucuucauaaguucguucaacgagaugcucaccgaguucaagaaggcacaaccugaacucuucuaccugaaaagcaacggagaagaaaccaaaaucccguacgacuggacauuauacuaccuccgcaagaaagcucuaucgcaaccccucacgaaacaagagcuugcauggaucauccucaauuucaaccaaaaacguggcuacuaccagcugcgcggagaggagauagaugacgacaaaaacaaacaauuuguuaaacuaaaagucaaggaggucaucaacucgggcgaggcugucaaagggaaaccacuauucgaugucaucuucgaaaacggguggaaauacgacaagcaaguaguaaaaacugaggacuggaucgaccgcaccaaagaguucaucgucaccacuaagguccucaaaaacggcgaccuuaagcggucuuacaaaacgguggacucggaaaaagacugggcagcuaucaaagccaaaaccgaacaggacaucgaacgcuccaacaaaacagugggagaguucaucuacgaaaccuuacucgaaaaccccacccaaaagauccggggaaaacugguuaaaaccaucgaacguaaauucuacaaagaggaacucaaaaacauccuaauuaaacaaauagaacuccaacccacacuguucagcgaagaacuauacaaagccugcaucgaagaacuguacccgagaaacgaggcccaccaaaaugccaucaaaaaccgggauuucaucuaccuacuaauggacgacauaaucuucuaccaacguccccugaaaagccagaaaaguaacaucucuggaugccaguuggagcaacgcguauacuacaaagccaacaaagacuccggcgaaaacgaagagguaaaacaagccgugaaagccauaccaaagagccacccccuauuccaagaguuccgcaacuggcaauggcugcagaaccuaaagauauacaacaaaguggauacagaaaaaggcgaacuuacggacgucacgaaacaacuucucccgagugaagacuccugggucaaccucuucaacuuucuccaaugcaagaaggaacuggaacaaaagcaguucauuaaguacuucaucgacaagaaauugaucaacaaaaccgagaaagaccacuaccgcuggaacuacgucgaagacaagaaguacccguucaccgaaacgcgcgcacaauucauaagccgacucacgaaaguagaaggaaucgaagaaauaaauacuuuccuagacaagaaaacacaaauaggcacuaaggacaacucccccuuugugucccgcaucgagcagcuauggcacauaaucuauagcgucucagacaucaaggaguacgaaucagcacuggaaaaguucgcgauaaaacaccaccuaaacgaggagucguucgucgccaacuuuaucaaauucccacccuucaaaucagauuacggaucguacucgaagaaggcacuuaacaagcuccuaccccucaugcgucguggcaacuacuggaccgagaacgacauaucggagaaaguaaagcuaagaguaagcgagaucauggaaagaguaaacgcccucaaccuaaaggaagacuacucaucaaaagagcuggccgaaacacucgucaacgucuccgacgacgacguaaagaaacaacuuauaaagagcuucgugagcuucaaagaccgcaacccacucaugggacucaacacguuccaggcgacguaucugguuuacggccgacacuccgaggugggcgacauacagaacuggaaaacccccgacgacaucgacacauaccuuaaaaacuucaaacaacacucccuacguaaccccauaguugaacagguaguaacggagacgcuccggguggugcgagacaucuggaaacaucacgggaaaucacagaccaacuucuucaacgaaauccauguugaacucgggcgcgagaugaaaaacccggcggacaaacgaaagcggaucagcgaacgaaacaccgaaaacgaaaacacaaacaaccgcauccgagagauuuugaaggaccuaaugaacgacgccucgauccagggagacgugcgcgacuacucaccuucccaacaagggauucuaaagauauacgaggagggcgucuaccaaaaccccaagguagacuacaguaaaguguccgaggacgagaucacgaaaauacgacguuccaacaaccccacccaaaaagaaauccaacgcuaccgccuuuggcuggagcagggguacaucucaccguauaccugcaagccgaucccccucagcaaacuuuucacacaccacuaccaaauagaacacaucauaccccagucacgcuacuucgauaacucaucaagcaacaaaauaaucugcgaguccgaagugaacgaagacaaggacaacaaaacggcauucgaguaccuaaaagauaaaggggaaaacgucauaaacggucacaaacuccuuucccucgccgccuacgaagcacacguaaauaaauacuucaagaacaaccgucaaaaguugaaaaaccuccuaucagaagacauccccgaaggcuucauuaaccgacaaaugaacgacucgcgcuacaucuccaagcuagucaaagggcuacucucgaacauuguacgugaagagggagagcaagaaguaacaaguaaaaaccuaauccccgucaccggcucaguaacaucuaaacugaaaaacgauuggggacugaacgacaaauggaacgaacucauccuuccucgcuucaaaaggcucaaccaacuaacccagaccaacgacuuuacaacggcaaauacaaauggcaacacgauacccaccgucccagacgaacuucucaaaggcuucagcaaaaagcgcaucgaucacagacaccacgcccuugacgcccugguagucgcaugcugcacacgcaaucacagcaacuaccucuccgcgcuaaacaccgaaaacaaaaacuacggacugcgagacaaguugcucauaaagaaugacaacgaccacuacacaaaauccuuccaaaugcccuggcacggcuuuacaacagaagccaaaaaucaauuggaggagacaguaauauccuucaaacaaaaccugcgagugaucaauaaggccaauaacaaauucugguccuacaaagacgagaacgggaaguugaaccuggacaagaauggaaaaccaauaaagaaacucagaaaacaaaccaagggcgauaacugggcaguccggcaaccucuccacgaagaaacaauauccggcauagucaaucuccccuggguuaaggcagaaaaggaaaaauuuacauacgccacccgcaagucacuggacaagagcuucgaccuaaagaaaaucgagaaaaucaccgacacugguauccagaaaauacuccggaacuaucuuaugcaagaaaaauucaaagaacucgacaagaaagacaaagaggucuacaacucggaacuggcauucucccaagaagggcuggaagaucuaaacaguaacaucgagcaauucaacgaccaaaagccccacaagcccaucuacaaagucagacuguucgagaaagggagcggucgcuucgccuuagguuucaagggaauuaacgccaagaaauaugcccaagguuccccgaacuuguauuuuaauauauaucgcaacgaggacggccaauacuacgagaccgucccacucaacaaaguuaucauccaccaaaagaacgccgcaaacaugccgaaaaagaaccgcacccccgucccaaucucaaacacagccauaaaccgaucgaaagagguucuaguggacuacaaaaugacccucagcccccuagaccuaguuuauauacccaccgaagaggaauuaaacaacauaaacucacuggacuucaauaaccugucaaaaagucaacgcaaacgauuguacaacgucaacgacuucucagguuacacaauuuacuucuccccuaacacucuugcgaaaucgaucuguccaaaggaaguagacaugaaguucgacgagaagaaacaaaaacccacggguagcuucgacagcaaaaccgcuucucucgacggaaugucgauuaaagaacguugcauuaaacucaucauagaccggcucgguaacaucaguaaagcauga

SEQ ID NO: 6913 - RNA, 4539 nt, Artificial Sequence
  Cas9 variant
augaaaaagauacuagggcucgaccuuggcaccaacuccauugguugggccgucgugaacgcugacgaaauaacuagggaugacggcucccgauaucugaagcccaauggaaucagcgccgcuggcagucguaucauaccgaugagcgccgacauccucggcgacuucgaaaaaggcaacaguaucucccagacggcagagcgcacccggaugcguauggcacgccgacuccacgaaagagcacuccuucgucgcgagagguuacucagaguccucaaccuacuagauuuucucccgaaacacuucgcagacaagaucgacagguauggaaaguucacagacgacagcgaacccaagcuggcauggcguaagaacaccgaaggaaaguacgaauuuaucuuccaagacgcauucaacgaaauguuagcagaguucaaagacaagcagccggaaauaguagaagagggaaagaaaauccccuacgacuggaccaucuacuacuuaagaaagaaggcccuugaaaaggcacuuaguaaggaagaacucucauggauacuacugcaauuuaaccagaaacggggcuacuaucaacuccgcggggaggaagaggagaucccgcaagacaagaaaaucgaauaccuggcacaaaagguggucaaagucgaggcaaccgaccaaaagaagggcgacgacgucugguacaacgucuaccuggagaacgguaugaucuaccgccgaaccucaaaagccccacucgacugggaaggcaaagucaaagaguucaucgucacaacagaaguggaaaacgacggggaaaccccaaagaaggacaaagaaggcaacaucaaacgcucauuccgcgcaccaaaggaagacgacuggacccuucugaaaaagaaaacggaggcggacauagaaaacagucacaaaaccgucggaugcuauaucuacgacucccuacuaaacaacccgaaacagaaaauaauuggcaaacuuguacgcaccguugagcgcaaauucuacaaagaagaacucacccaaauccuuaaaaagcaaguagagcucauuccagaacuacgcgacgacaaucuauauaaacaaugcaucgaagaauuauaccccauaaaugaggcgcaccgaaacaccauagcgaaaacggacuucgcaaaucuauucaucaaugacauccuauuuuaccagcgccccuuaaaaagcaagaagucacaaauagauaacugccccuaugaggaacguauauucaucgauagcaagaccggagagaagaagaaagucccuguaaaauguaucgcgaaaucaaacccacuauuccaagaauuucggcuguggcaauucauccaaaaccugcgaauauaccaaagggagaaagagauagacgggaaacuacugaccgacauagacaucaccucagagugccugaaauccgaggaagauuacgugcgccucuucgacuggcugaacgaccgggaaacaauagaacaggaagaccuacugaagcaccuauucaacaccaagaaaucaaagaacaaggaaaacccguaccgguggaacuacguagaagauaagguauacccgugcaacgaaaccagagcaacgauccucaaaggcuucuccaagugcggaauuaaugcauccgugcuaaguccagagcuggaaauggcccuauggcacauccuauauagcguagaggacaagaaggaaauagaaacagcacuaacccacuuugcgcaaaaacaggguuggaaugacgacuucgcaaaggucuucucaaaagccaagccguucaagaaagacuacgguucguacuccgaaaaagcgauaaagaagcuguuaagccugaugcguaugggcaaauacuggaaccaagauaacaucgacaaaaacacguuagacagaauagacaagauaaucaacggagaauacgacgaaaagaucucaaaccgcguccgggacaacgcaaucaaccuaaaagacauaucugauuuucggggccuaccggucuggcuggcguguuacaucguguacgaccgccacucagaagcaaaagacugcacuaaguggaacuccccggaggagauagauagcuaccuaaagaaauucaaacaacacucgcuucgaaaccccaucguggagcaggucguaacagaaacgcuccgcacagucagagacaucuggauccaagaggaacagaucgacgaaauccaccucgaacugggccgcgaccuaaagaacccagccgacaaaaggaaaaagaugucggaaaauauacucaaaaacgagaacacaaaccuaagaauaaaggccaugcuaauggaguucaugaaccccucgaugggcauagaaaacguccgacccuacagucccucacaacaggacauacuccggaucuacgaagagaacgcacuagacaaccugaccaaagacgacaaggacuucgacuucauuucaaaaaucuccaagcaagcccagcccagcaaaacagacauuauccgguauaaaugcuggcuagaacaaaaguauaggaguccauacacuggcaaaaccauuucccucagcaaacucuucaccccggcguacgaaaucgaacacguuauaccacaaagccucuauuucgacgacucguucucaaacaagguaauuugcgaagcagaaguuaacaagcucaaggauagacaacuaggauacaaauucaucgcggaacaccacggugagaaaguacagcuuucgcaaggagagguggucgaaaucuuaagcgucgacgccuaugagaaauucguaaaagagaacuacgccaacaaccggaucaaaaugaaaaagcugcucauggagaguauacccgacgaguucauagaacgacaacuaaaugacagucgcuacaucuccaaaguggugaaagguuuauugaguaauauaguacgugagaaaaucgacgacgaaaauuacgaaccagaagcgguguccaaaaaccucauaagcugcaacggcgccauaacugaucgacucaagaaagacugggggaugaaugacguauggaacucgaucauacugccucgauucauacgaaugaaccaaaucacaggcaaagacugcuucaccacaacgaacgccgagggccaccuuauuccgcagaugcccuuagagcuacagaaaggauucaauaagaagcguaucgaccacagacaccacgcgauggacgccaucgucauagcaugcacuacgagagaccaugucaaccuccucaacaacgaagcggcccacagcaaauucaacgccacgcgauaccagcuacagcgaaaacuuaggcgauucgaaaaggccgucauagacggaaaggaacgggaagucgccaaagaguuccuaaaaccaugggacucguucuccagcgacucgaaaaacauauuagaaaacaucaucguuucauucaaacaaaaccagagagucauaaacaagacaaccaacgccuuuuugcacuucgacgagaacgggaaaaagacguucaucaagcagggcaagggcgacagcugggccauacgaaaaagcaugcacaaagacacaguauucggcgaaaucaaccuccgcaaagucaggucuguaucacucaacgaagccauaaaaguaccagaacgaguacugaacaagaaaaucaaagagaaaauacucgaacucaagaacaacaaaaucgaugccaaaaauaucaaaaaguacauagaagaaaaccacacgggaggcuacggaaucgacagcucgaaaaucgacgucuucuacuucaccaaagaaacaaaggagcgauucuucgcaacaagaaaaacgcuggacacgagcuucaaccaggcaaaaaucaaagauucgauagcugacagcggaauccaaaagauacugcuagcacaccucaaguccaaaaacggcgaugcugagcaagccuucagccccgaugggauagacgagaugaacaagaacauaguugaacucaacaacgggaaguuccaucagccaauccuaaaaguccggguguacgaaaaagccgacaaauucgccguaggacaaaaaggcaacaagaaggucaaauucguagaggcagccaaaggaaccaaccuuuucuucgccaucuucgagaaagacggcaaacgcucauaucuuaccauuccccugaaugucaugaucgacugccagaaacaauacggcaaccaauggaagaacaacaucgaggccuaccuuaaagaaaaagagcuagucgaaaaggacgucaaacuccaauucauacucagcccaaacgaccugguguaccuccccacggaagggagcauagacaagaaacgcaucuacaaagucgucuccuucaccaacaaucggcuauacgccauccccuacgcgaucgcaaaaagcaucguugacaaaaacgaguucacacaacugaacaaaauagaguucaccgacaacaaagaaucaaucaaagacgccuguguaccagucaucaucgacaggcuaggcaacgugauagaguucaacggaaaacgccuauga

SEQ ID NO: 6914 - RNA, 4539 nt, Artificial Sequence
  Cas9 variant
augaagaacauacucggacuggaccucgggacgaacagcaucgguugggccguaaucaacucagaagaagacggcccaaucgucaagaagcgcaucgaauuagccggcagcagaaucauuccgauggacgccgcaguccuaggcaacuucgacucggggguaacaaagucucaaacggcggaacgaacgagcuuccgcucaauccgccgccuccgcgaacgacaacuccuccggcgggaacggcugcacaaagugcuucagauacuaggcuuccugcccgaacacuacguaaacgacaucgacuucgaaaaccacccugggaagauaaaacguaacacggaacccaaacuaccguggcgaaagaacagcaugggccaauucgaguucauuuuccaagacucguucgaggcaauguugaccgacuucgcgacacaccaaccagucuucguaagcgaagggaagaaagucccauacgacuggacccuauacuaccuccguaagaaagccuuaacagaagguauuucuaaagaggaacuggccuggcuuauucucaacuucaaucaaaaacgaggauacuaccaacugcgcggcgaagaggaagaggaacagucgaacaaacugguggaauuuuacgcacugcgcgugguuaaaguggaagcaacugacgacaagaaaggcaaagacacgugguauaacgugcaccucgaaaacggguggauauaucgccgaacgagcaacauuccacuggacugggaagggaagguaaaagaguucaucgucacgaccgaccuaaaugaagacgguaccccuaaacuagauaaauacggggaaguuaaacggucuuuccgugccccgaaagaagacgauuggacucuaauaaagaaaaagacagaauccgacaucgccaacagucacaagacaguuggaugcuacauauacgacgcacuccuccaaaacccccaccagaagauaaaaggccgccuugugcgcacagucgaacggaaguucuauaaagaagaacuucgacucauccuggaaaaacaacugucguuccacccagaacugcaagaccgagaccucuaccgggcaugcaucgacgccuuauacgucucaaacgaagcucauaaaaauaacauauccggcagggacuucguguaccuguucauagaugauaucaucuucuaccaacgcccacucaagaccaagaaaucacucaucgacaacugucccuacgaagaaaaccaguauauggacagagaaacuggcgaagucaaacaagcccccauaaaauguauagcaaaaucgcauccauuauuucaagaguuccgccucuggcaauucaucaguaauaucaggauauaccaacgagaacgaguccucgacgacggcaaacuagaaaccgaugucgacgugacaccggauuuccugaaaaccgaagacgacuacacuacccuauucgaaugguucaacgaucggaaagaaguugaccaaaaagcauuccucaaaaacccucaauucggauuaaagaagaccuucacagaauaccgcuggaacuacgucgaggacaaauccuaccccugcaacgaaacgcgcaacgcgauacugaacggacuccagaaagcuggagucuccgcagacuuccuaagccgcgaaguagaggaggcucuauggcacauacucuacucaguagaagacaagaucgagauagaauccgcccuacgcaaauucgccagcaagcacgaccucgacgaccgauucgcagaugucuucaagaaacugcccccguuuaagaaagaauacggcgcauacagcgccaaagcgauaaagaaacugcuuccgcugaugagaaucggcaaauacugggaacugucuaacaucgaugacaaaaccaaagagcgcaucgacaagaucauaacaggcgagugggacgaaaacauacacgacaggguccgcgaaaaagcaaucaagcuauccgacaucaccgacuucaaaggccucccacucuggcugucaugcuaugucgucuacaacagacacagcgaggcacgggcaauagccaagugggagucccccgaagacaucgacucauaccugcgcuuguuccggcaacacagccuaagaaacccuaucguggagcagguaauuaccgaaacgcuacggacugucagagacaucuggaagcggguaggacaaaucgaugaaauacacgucgaacuuggccgagagaucaagaaccccgccgacaaacgcgcgaaaaugaccgcccagauugucgaaaaugaaaacacuaaccuacgaauaaaggcacuacucgcggaguucauuaacuccgaauacgagaucgagaacgucaggcccuacucgagcaaucagcaagaaaaacucaaaauauacgaggauaccgugcugaacggaguuaaagaaaucccggaagacauaaacaccauucuaaagaaauuccgcgaauccgaccucaagaaacgcccuacaaaaagcgacuuccugcacuauaagcuguggcuagagcagaaguacuguucuccauacaccgggcguaucauaccccucggcaaguuauucacauccgccuacgagauagaacacauaaucccccaggcgcauuacuucgacgacagcuucucaaacaaagucauaugcgaggcugaaguaaacggccugaaagacaaaaagcucggauacgaguucaucaagcacaaccccggcaaaauggucgaaaucggauucgggaaaccucccguccgaauuuucucggucgaggaauacgaaagauucgugaaggagaacuacagcggaauaaagaacaagaugaacaaacuacugauggaugacaucccagaaacauucaucgaacgccaacucaacgacagccgcuacauuucgaagguggucaaaagucuccuaucaaacauagugcgggagaaagacuccaacggcgaauacgaaccggaagcaaucagcaagaacguaaucguaugcacaggcucggucacagaccgccucaaacgcgacuggggcgugaacgacgucuggaacuccauaaucuacccccgcuucgaacgccugaacgaacugaccgguucucaacaauucggcugcugggaaaacaaagaagggaaaagaguguuucaaacagcugugccccuagaaaugcaaaaaggcuuuagcaagaaaagaauagaccaccgccaccaugccauggacgcaaucguaaucgccugcgccacacgaaaccacauaaacuaucuaaguaacgaguccgccucaaagaaggccaagaucucucgaacugaccuacaacggcuccugugcaccaaaugcaggacagacgacaacgggaacuauaaguggauagucaagaaaccauggccagccuucacgcaagacauacgcaaagcccucgaaaacauuaccguuagcuuuaaacagaaccucagagucaucaacaaaaccaccaacuacuacguacacuucgacgaaucaggcaagaaaguucuagaaaaacaaauuaacggugacagcugggccaucaggaaacccaugcacaaagacaccgucuucggaaaaguaaaccugcagaaaguuaaggaaguccgcuugagccucgcccucgacacgccaaaaaugauugucgacaagaagcucaaagaaaagguccuccaacuuuacagcuacaaguacgacaagaaacgaauugauaaguacuuuaaagaaaaugccagccuuuggaaggaucucaaucucuccaaagucgcagucuacuauuucacaaacgacuccaccgaaccccuagucgcggucaggaagccacucgacacauccuuuaacgcaaagaaaauaaaagaauccguuacagauaccggcauucagaaaauacuccucaaccaccuaagcaacaaccaagaugacccaaacuuagcauucucgccagacggaaucgauaaaaugaacaagaaucugaccgcccucaacgacggcaaguaccaccaaccaaucuacaaagugcgcgucugugaaccccaaggaaauaaguucucagucggcacaagcgggaacaaaaccuccaaauacguagaggcggccaaaggaacuaaccuuuucuucgcagucuaucaaacagaagauggcaaacgaucguacgagacaauaccacugaacguagucauagagcgcgaaaaacuuggcuggacucccgugcccgagaacaacaacaacggcgacaaacuccuauucuggcuaagccccaacgaccucgucuacguaccuaccgcggacgaacucaacaacgguaugcgccucgauaacauggacaaagggcguaucuacaaaaugaucagcugcagcggaccacagugcuucuuuauaccccagaaugugagcaacgcaauuaucccaguaaucgaauugggcgccaacaauaaggcggagaaaagcuggaacaacgaaaugaucaagguggucugcguaccgauacguguagaccgacucgggugcauaacacaaaucaacaaccaaaaauga

SEQ ID NO: 6915 - RNA, 4551 nt, Artificial Sequence
  Cas9 variant
augaaaaacauccuaggccuugaucuggguacaaacucgaucggaugguccgugauacaagagaaacacaacgagaacaacgaaugccaaaaauuaauacucggcgcgggcuccagaauaaucccaauggacgcagcuguguuaggcgacuuugcaaaagggaacaccaucagucaaaccaaggaccgaacccaauaccgaggaguaagacgacuccgagagcgaugucuucuccgccgagagcgccuauuccggguccucgauauaaugggauucuugccccaacacuucagcaaugcacucaccagauacgggaaauucaaagaugccgaugaagaacccaaaauagcuuggcgaaaagacgacgaaggcaagaugcacuuccuauucgccgauuccuucaaugaaaugaucgaagaguuccguucuguucaacccgaacuccuuaaacguggcaugaaggucccuuacgauuggacccuauacuaccuccggaaaaaggcaaugcgcgaggcgguaacaccuuuugaacuagcguggcucauacuuucauucaaccagaagcgcggauauuaccagcuacgcggcgaggaagaaggagaggcagacaacucgaaauccgaggaauaccuagcccaacgaguggucgacgucauagacaccggcgaaaagaaaggcaaauccaccugguuugauaucguauuagaaaacgguauggucuaccacagaccagcagaaauaaaaccugacuggauaggaaaaacaaaagaguucauagucacaacucaauucgacaaagacgggaacccaaagaaagacaaagaaggcaacgucaagauguccuucagaaugcccaacgaaaacgacuggaaccugcagaaaaagaaggccgaaaaagacaucgacgaaucagguaugacgguaggcgaauacaucuacaacgcacuccuacacaacccgaagcagaaaauaaagggcaaacucguacgagucgucgaaagaaaauacuacaaaaacgaacugcagaaaauccuagaaucccagaaaagauuuaucccgcaacuuagcgacuccgcacucuacgaaaaauguauaaaagagcucuaccaaucaaacgaagcguaccgaaacagcauaucaaccagaaacgacuucacauaccuauucgucgacaacaucaucuucuaccaacguccauuaaaaagcaagaaaucccucauagauaacugcccguacgaaucccucgcauacaccaaggauggggaagaacauaaggccccggucaagugcaucgccaagucccacccccuuuaccaagaguuccgacuguggcaauucaucucgaaccuaagaaucuaccaacgccaaaaacaagugggggauaaaguaaaacucgacgucgacguaacagaugaguuccucccaacagacgacagacgagagagcuuauucgauuaucugaacgacaagacagaaauaaaacaagacguacuguuaaaggaguucuucuccaugaagaaaccaaaaggcaaagacagcguguaucccuacagauggaacuacgucgaagacaaaagcuacccaugcaacguaacaaggggaaagauacuagccaagcucaauagagccggaaucuccgcagacuuccugagcucgaacggcaaugaagaaagucucuggcacauccuguacagugucgaagacaagggcgaacuccggaaggcacuagcaagauucgcggccaaaaacggccuggacgacgcauucaccgaagcucuugcugacaucgaaccuuauaagaaagaauacggggcauacuccgcaaaggcgcucaagaagcuacugccacuaaugcgacuugggaaauacuggaacuacgacaacaucgcgccugcgacaaaggcgcggaucucgaagauaauagacggagaguacgacgagaacauacgcaacagaguaagggagaaggcaaugucgcucaacucagcaagccaauuccaaggcuugccccucuggcucgccuguuacauaguauacgaccgacacuccgagcgggcggacucgggccgguggucaucccccgaagacauagacaaauaccuaagcgacuucaaacaacauucccuacggaacccaauagucgaacaagucgugacggagacgcuacgcacgguccgcgacauauggaaaagguacggagaaauuagcgagauacauguagaacucgggcgagagaugaagaaccccgcagacaaacgcuccaagaugaacagaaggaugcuagaaaacgaaaacgccaacaugcgagccaaacuacuacucaccgaguucaugaauccggaguucgguaucgaaaacguccgcaguuacucaccaagccaacaagaacuccucagaaucuacgaagauggagcaaucagcaacgccggcagcgaaaucgacgaugaaauaagcgacaucaugucaaggcuaagccaaguagacgucaaaaagcagccaacggcaucugaagugaaaagguauauacucuggcuagaacaaaacuacagaucacccuacaccggccagaugauuccgcucgcaaaauuauucacgccagcauacgaaaucgaacacguaauaccccaguccagguacuucgacgacagcuuuagcaacaaggucauuugcgaggccgaaguaaacaaacuaaaagaccgaaugcuuggguacgaguucaucaaacaacacaagggcgaaaaagugucacucucaaugggcggaaccguagaaauccucagccccgaggaauacguucggcacguggaaucccaauacaaaaacaacaaagccaaaaugcgaaaacuacucauggacgacauaccagacgaguucauaaaccggcaacucaacgacagcagauauaucagcaaacugauaaucucccuccugucaaacaucguccgcgaagaaggcgaagaagaagccaccagcaaaaacgugaucuccugcaacggaagcauaacagacagacuaaagaaggacugggggauaaaugacguguggaaccauauaauacucccacgcuuccgacgccugaacgagcuaacuggcaccgacaaauucacuacguccaauaaggaaggccacgagguuccagaaaugccccucgagcuccagaagggauucaacaagaaacgcauagaccaccgccaccacgcaauggacgccaucguaaucgcaugcauaacgagagaucacgugaaccuucucaacaacgaggcagcgaugucgaaaaacaaugcaaaccgcauccagcucuccaaaaagcugagacgcuacgaaucuguggagauagaaaaggauggcauccgaaaacaaaucucgauggccaaagaguucaagaaacccugggaaggauucacagcugacguagagaggacccugagggacaucguugucuccuucaaacagaaucuucgugucaucaacaagacaacaaacuacuaccagcacuucaaggacgggaaaaagauauacucgccccaguccaaaggagacagcugggcaauccgcaaguccaugcacaaggagacaguauucggagaaaucaacaucagacggaucaaagaggucucccuaaaagaggccaugaaaagaauuaaagacaucgccgacaaagagcuccgguccaagaucgucgaacuaauggcgcuacaauacaaugaaaagaagauaaagcaauacuucagcgacaacaaggacgaguggagugaugucaacccaaagaaaauaaaaauccacuauuucacaaaagagaccaacgaacgauucuucgccacccggaaaccccuagacacgucauucgacaaaaagaaaauaaaaacccaaguagcagacaccgcgauccagaaaauacucuuaaaucaccugucagcacacggcgauaaagcagagacagccuucucacccgacgggauagaugaaaugaaccguaacauuaucgaacucaacgacggcaaauuccaccaacccauccuaaaagugagaauauaugagaaagcugauaaauacgcaguaggacaacagggcaacaaaaagaagaaauacguagaagcagccaaaggaacaaaucucuucuucgcaauuuacgcugaagagaaaaucgacgagaaaaccggcgacacagucaucacaagaaccuaugacagcauaccccuaaacgucgucauugacagagaaaaacgaggacucagcccagucccagaaaacgaaaacggcgccaagccgaaguacgugcucucaccaaacgaccugguauacguacccaacgaagaagaacgugagacgggacgaaucugcgaaccgcucgacaaagaaagaauauacaaaauggugagcucaaacaaaaagcaggccuucuucauaaaaagugaagucgccucgaccauuguggacaaauucgaguucucagcccugaacaagcaagaacgcgcccugucaggagaaaugaucaaagaaauaugcauccccaucagcauuaaccgcauaggcgaaaucacgcugagauga

SEQ ID NO: 6916 - RNA, 4554 nt, Artificial Sequence
  Cas9 variant
augaagaaaaucguaggccuggaccucggaaccaacuccauaggaugggcucucaucaacgcauacaucaauaaagaacaccucuacggaauagaagcaugcgguucgcggauaauaccuauggacgcagccauacugggcaacuucgacaaaggcaacucgaucucccaaacggcagaccgaacaaguuacagggguauccgccgacuccgugaacgccaccuccucaggcgcgagcgccugcaccgaauacuggacuuacugggcuuucugcccaaacauuacucagacagucugaacagauacggcaaguuccugaacgacauugagugcaaacuacccuggguaaaggacgagacaggcucuuauaaauuuaucuuccaagaguccuucaaagaaaugcucgccaauuucacggagcaccaccccaucuuaaucgcaaacaacaagaaagucccauacgacuggaccaucuacuaccuacggaaaaaggcccucacccaaaagauaucgaaggaagaacuagcauggauccuccucaacuucaaccaaaaacgaggauacuaccaacugagaggugaggaggaagaaacccccaacaagcucgucgaguacuacucgcucaaaguagagaagguugaggauaguggggaaaggaaaggaaaagauacaugguacaauguccaccuagagaacggcaugauauacagacgcaccucaaacauaccgcucgacugggaaggaaagacaaaggaguucauaguaaccacagaccucgaagcggacggcucgccaaagaaggacaaagaaggaaacaucaagcgcucauuucgagcaccaaaagacgacgacuggacccuuauaaagaagaaaacugaagccgacauagacaagauuaaaaugacagucggcgccuacauauacgacacgcuacuccaaaaacccgaucagaaaaucagaggcaaacucgucagaaccaucgaacgaaaauacuauaaaaacgaacuauaccaaauccuaaaaacccagagcgaguuccacgaggaacuaagagacaagcagcuuuacaucgccugucugaaugaacucuacccaaacaaugaaccgcgaaggaacuccauuucaacacgcgacuucugccaucuauucaucgaggacaucaucuucuaccaacgcccacucaaaucuaaaaagagccugauagauaauugccccuacgaggaaaacagguacaucgacaaagaaaguggcgagauaaaacacgcgagcaucaaauguauagcaaaaucacaccccuuauaccaggaguuucgacuuuggcaguucaucgucaaccuacggaucuaucguaaagagacagacguugaugugacgcaagaacuccucccgacagaggcagacuacgugacgcucuuugaauggcuaaaugaaaagaaagaaauagaucaaaaagcauucuucaaauaucccccguucggauuuaagaaaaccacaucgaauuaccguuggaacuacgucgaagacaagccauacccaugcaacgaaacgcacgcucaaaucauagccagguuaggaaaggcacacaucccgaaagccuuccucaguaaagaaaaggaggaaacacucuggcacauccuauacucaaucgaggacaaacaagagaucgaaaaggcgcuccacagcuucgccaacaagaacaaccucagcgaagaguucaucgaacaauucaaaaacuuuccacccuucaagaaagaguacggcagcuacuccgcuaaagccaucaaaaagcugcuaccccucaugcguaugggcaaguacugguccauagaaaacauagacaacggcaccaggauucggaucaauaagauuaucgacggggaguacgacgaaaacauccgcgaacgaguccgccaaaaggcaaucaaccucacagacaucacccacuuccgcgcccugccgcuauggcucgcauguuaccuugucuaugaucgucacucggaggugaaagacaucgugaaguggaaaacccccaaggacauagaccuguaccucaaauccuucaaacagcacucuuugagaaaucccaucgucgaacaggucaucacagaaacucuccgaaccguucgagacauauggcaacaagugggccacaucgacgaaauccacaucgaauuaggccgagagaugaagaacccggcggacaaacgggccagaaugucucagcaaaugaucaaaaacgaaaauaccaaccuacggaucaaagcgcuccucacugaguuccuaaaccccgaguucgguaucgaaaacguacgacccuacagccccagucagcaagaccugcuccgcaucuacgaagaaggcguccuuaacaguauccucgaacuaccagaagacaucggcauaauccugggcaaguucaaccaaacagacacccucaaaagacccacccgcuccgaaauacuccguuacaagcucuggcucgaacagaaauacagaagcccauacacaggagagaugaucccccuuucgaaauuguucacgccagcauacgaaaucgaacacauaauaccacagucgagauacuucgacgacucacucagcaacaagguaaucugcgagucagaaaucaacaagcuaaaagaucgaucacuaggauacgaguucaucaagaaccaccauggcgaaaagguggaacucgcauucgacaaacccguggaaguccucagcguagaagccuacgagaaguuaguccacgagagcuacucgcacaaccgguccaagaugaagaaacuccuuauggaggacaucccggaccaauucauugaacggcaacuuaacgauucucgauacaucagcaaaguagugaaaucacuauugucgaauaucgucagagaagaaaacgaacaggaggcaauaucgaagaacgucaucccaugcacaggcgggauaaccgaccgacugaagaaggacugggggaucaacgacguauggaacaagaucgugcugcccagguucaucagacugaacgaacuuaccgaguccacccgcuucaccucgaucaacaccaacaacacgaugauuccgagcaugccacucgagcugcagaaaggcuucaauaagaaacgcaucgaccacaggcaccacgcgauggacgcaauaaucauagcaugcgccaaccggaacauaguaaacuacuuaaauaacgugucagccuccaaaaacacuaaaaucacccgcagggaccuacaaacacucuugugccacaaggacaagaccgacaacaacggaaacuacaaaugggugaucgacaaacccugggagaccuucacacaagacacgcugacagcacuccagaagaucacaguuuccuucaaacaaaaccuccgagucauaaacaaaacaacuaaccauuaccagcacuacgaaaacggaaagaaaauaguaagcaaccagucaaaaggcgauagcugggcaauaagaaaaagcaugcacaaagaaaccgugcauggggaagucaaccugcgcaugauaaaaacagucuccuucaaugaggcccucaaaaagccccaagcaaucgucgagauggaccuuaagaagaaaaucuuggccaugcuagaacugggcuacgacacaaaacguaucaaaaacuacuucgaggaaaacaaagacaccuggcaggacaucaaccccucaaaaaucaagguguacuacuucacaaaggaaacaaaggaccgcuacuucgcaguccgaaaaccaaucgacaccagcuucgauaaaaagaaaauaaaagagucaauuacagacacaggcauacagcaaaucaugcuacggcaccucgaaacaaaagauaaugaucccacacucgccuucucacccgacggaaucgacgagaugaaccgcaacaucuuaauccuaaacaaagguaagaaacaccaacccauauacaaaguccgcguuuaugaaaaagcggaaaaguuuaccguaggacagaagggaaacaagcgaacuaaauucguggaggccgccaaaggcacuaaccuauuuuucgcgaucuacgagacagaagagauagacaaagacacgaaaaagguaauccggaaaagaagcuacucgacaaucccgcugaacgucgucauagaaaggcagaagcagggacuuuccuccgcgcccgaagacgaaaauggcaaccuucccaaguacauacucagcccaaacgaccuaguguacguuccgacacaagaagagauaaacaagggagaaguagucaugcccaucgaucgugaccgcaucuacaagaugguggacaguagcggaauaaccgcgaacuuuaucccagccagcaccgcgaaccugaucuucgcccuacccaaagccacggccgaaaucuacugcaacggcgagaacugcauacaaaacgaauacggcaucggcaguccccaauccaaaaaccaaaaggcaaucacaggugagaugguaaaagaaauaugcuuuccaaucaaagucgaccgguuaggaaacaucauacagguagggagcugcauucugaccaacuga

SEQ ID NO: 6917 - RNA, 4563 nt, Artificial Sequence
  Cas9 variant
augaagaaaauagugggccucgaccuaggcaccaacucaauaggcugggcccuaaucaacgccuacauagacgaauauaacaaagaacaccucuacgggaucgaggcauguggaucccgaaucaucccaauggacgcagccauucuaggcaacuucgacaagggaaacuccauaagccaaacggcagaccgaacaucauaccgaggcaucaggcggcuccgggaacgccaucugcuacggcgcgaacgccuucaccgcauucucgaccuguuaggcuuccuaccaaaacacuacuccgauagccucaaccgcuacggcaaauuccuaaaugacauagaaugcaaacuaccauggguaaaggacgaaaccggcucauacaaguuuauuuuccaagaaucguucaaagaaauguuagccaacuucacugaacaccacccaauacuuauagcaaauaacaagaaagugcccuacgacuggacaaucuacuaccuccgaaagaaggcccucacucaaaagaucagcaaagaggagcucgccuggauccuccuaaacuucaaucagaaaagaggauauuaucaacuccgaggagaagaggaggaaacacccaacaaacuugucgaauacuacagucucaaagucgaaaaaguggaagacuccggugagcgcaaaggaaaagacacgugguacaacgugcaccuggagaacggcaugaucuaccgaaggaccucaaacaucccacuagauugggagggcaaaaccaaagaguucaucguaaccaccgaccucgaagcagacggcucccccaagaaagacaaggaaggcaacaucaaaagaucguuccgcgcaccuaaggacgaugacuggacgcugaucaagaagaaaacugaggcagacauagacaaaauuaaaaugacaguaggggccuacauauaugacacucuccuccaaaaaccggaccagaaaauacgcgguaaauuagugcgaacgauagagcggaaauacuacaaaaacgagcucuaucaaauucuaaaaacgcaaagugaguuccacgaagaauuaagagacaaacaacuauacaucgcgugccucaacgagcucuacccuaauaaugaaccgcgccgcaacagcauaucgacccgggacuuuugccaccuuuucaucgaagauaucaucuuuuaccaacgcccacuaaaaagcaaaaagucauuaauugacaacugccccuacgaagaaaaccgguauaucgacaaagaaucaggcgaaaucaagcacgccuccauaaaaugcauagcaaagucucacccacuauaccaagaguuccggcuuuggcaguucauugugaaccuucgcaucuaccggaaagagaccgacguagacgucacacaggagcuccugcccaccgaagcagauuaugucacccuguucgaaugguugaaugaaaagaaagagaucgaccaaaaggccuucuucaaauacccacccuucggauuuaagaaaacaacgagcaauuaccgcuggaacuacgucgaggauaagccguacccaugcaacgagacgcacgcccaaaucaucgcgcguuuaggcaaggcacacauccccaaagccuuccucagcaaagagaaggaagaaacauuauggcacauccuauauaguaucgaggacaaacaagaaaucgaaaaagcccuacacagcuuugcuaacaaaaacaauuuauccgaggaguucaucgaacaauucaaaaacuucccgcccuucaagaaagaauacggauccuacagcgcgaaagccaucaagaaacuccuaccccuaaugcggaugggcaaauacuggagcauagagaacaucgacaacggcacaagaauacgaaucaauaaaaucaucgauggagaauacgacgagaacauacgcgaacggguucgccagaaagcaauuaaccuuaccgacaucacccacuuccgcgcauuaccgcuauggcuagcaugcuacuuaguauacgacagacacagugaagucaaagacaucguaaaauggaaaauuccaaaagacaucgaccucuaucucaagucauucaagcagcauagucuccgcaauccuauaguagaacaaguuauaaccgagacccuccggacugugcgagacauauggcagcaggucggucacaucgacgagauacacaucgaacucggccgcgaaaugaagaacccggcugauaagcgcgcacgcaugucccagcagaugaucaagaaugagaauaccaaccuccgcaucaaagcccugcuaacagaguuccucaaccccgaguucggaaucgaaaaugugcgaccauacucccccucccaacaggaccuccuucgcaucuacgaagaaggcguccucaacucuauccucgaacugccagaagacauaggaaucauccucggcaaauucaaccagacagacacacucaaacggccgacucgcuccgagauccuccguuauaaacuauggcuagagcaaaaauaccguagccccuauaccggugaaaugauaccccucucaaaacuauucaccccugcguacgaaaucgaacacaucauaccucaaagccgcuacuucgacgacuccuuaagcaacaaagucaucugcgagucagagaucaacaagcugaaagaccggucacucggcuacgaauuuauuaaaaaccaccacggugaaaagguugagcucgcguuugacaagcccguugagguguuaagcguugaggcauacgaaaaguugguacacgaguccuacucacacaaccgaagcaagaugaagaagcucuuaauggaagauauucccgaccaauucauagagcgccagcugaacgacucccgcuacauaucaaaggucgucaagagccuccucucaaacauuguacgcgaggagaacgaacaagaggccaucagcaaaaacguaauaccauguaccggagggauaacagaccgacuaaagaaagacuggggaauuaacgauguauggaauaaaaucguccuaccccgauuuauccgacugaacgaacuuacagaaucaacccgguuuaccuccaucaacaccaacaacacuaugaucccuucaaugccacuggagcuacaaaagggcuucaacaagaaacgaaucgaccaccgacaucacgccauggaugcaauuauaauagcaugcgccaacaggaacauagucaacuaucugaauaaugugagcgcauccaaaaacacgaaaauaacucgcagagaccuccaaacacuccucugccacaaagacaagacagauaauaacggaaauuacaagugggucauagacaagccgugggaaacuuucacccaagacacgcuuaccgcacuucagaaaauaacuguuucauucaaacaaaaccugagaguuaucaacaagaccacaaaccacuaccaacacuacgaaaacgggaagaagauagugucgaaccaauccaagggggacagcugggcuauucgaaaaagcaugcauaaagaaacuguacacggagaagucaaucuccgcaugauaaagacagugagcuucaacgaagcccucaagaaaccccacgccaucgucgagauggaccuuaaaaagaaaauccucgccauguuggagcuggguuaugacaccaaacggaucaaaaacuacuucgaagagaauaaagacaccuggcaagauaucaaccccucaaaaaucaaagucuacuacuucaccaaagaaacaaaagauagauacuuugcgguccgcaaacccaucgacaccagcuucgacaaaaagaaaauaaaagagagcauaaccgacacaggcauccaacagaucaugcuccgucaccuagagaccaaagacaacgacccaacccucgcguucucccccgacggcaucgacgaaaugaacagaaacauccuaauccucaacaaaggcaagaagcaccaacccaucuacaagguaagggucuacgaaaaggcagagaaguucaccgucggccaaaaagguaauaaacgaacaaaguuugucgaagcagcaaaagggaccaaccucuucuucgcaaucuaugaaacggaggaaaucgacaaagacaccaagaaagugauacgcaaacgaagcuacagcacuaucccacucaacguagucaucgagcgccagaaacaagggcucucguccgcuccagaggacgaaaacggcaaccuacccaaauacauucucagcccgaacgaccucguauacguccccacgcaagaggaaaucaacaaaggcgaagucgucaugcccauugaccgggaccgcauauacaagaugguagauucaagcggaaucaccgccaacuucauacccgcaagcaccgcgaaccuaauuuucgcgcuaccaaaggcaaccgcugagauuuacugcaacggagaaaacugcauccaaaaugaauaugggauaggcucuccacagucgaagaaccaaaaagcuauaaccggugaaauggucaaggagauauguuucccgauuaaaguagacaggcucgggaacauuauccaggucggauccugcauacucacgaacuga

SEQ ID NO: 6918 - RNA, 4563 nt, Artificial Sequence
  Cas9 variant
augaaaaagaucguaggccuagaccucggcacgaacaguaucgggugggcgcuuaucaacgcauacaucgacgaauacaauaaagaacacuuguacggcauagaagccugcggaucacgcaucaucccgauggaugccgcaauccucggcaacuucgacaaaggaaauuccaucagccaaacagcugaccgcaccucauaccgagggauaagacgacugcgagaacgacaccuauuaagaagagaacgccuccaccgaauacucgaccuucuagguuuccuccccaaacacuacuccgacagccugaacagauacggaaaguuccucaaugacauagagugcaaacuccccuggguaaaagaugaaacaggguccuacaaguucauauuccaggaaucauucaaagagaugcucgcgaacuucaccgaacaccaccccauccuaaucgccaacaacaagaaagugccauacgacuggacaaucuacuaccuccgcaagaaagcccucacgcagaaaaucuccaaagaggaacucgccuggauacuccucaacuucaaccaaaagcggggcuauuaccaacuccguggagaagaagaagaaacgcccaacaaacucgucgaauauuacucacugaaaguagaaaagguagaggacuccggcgaaaagaagggaaaagacacaugguacaauguucaccuagaaaacggaaugaucuaucgacgaaccuccaacaucccccucgacugggaagguaaaacgaaggaguucauugucacuaccgaccuggaagccgacggcagccccaagaaagacaaagaaggaaauaucaagcgcagcuucagagccccaaaagacgacgacuggacucuaauaaagaagaaaacggaagcagacauagacaaaauaaaaaugacagucggagccuauaucuacgacacccuccuccaaaaacccgaucaaaagauccgaggaaaauuagucagaacuaucgagcgaaaguacuauaaaaacgagcuuuaucaaauccuaaaaacacaaucagaguuccacgaagaacugcgugacaaacaacuguacaucgccugccugaacgaacuguaccccaauaaugaaccacggcguaacucgaucucaacaagagacuucugccaucucuucaucgaagacaucauauuuuaccaacgcccacuaaagucaaagaaguccuuaauugacaacugccccuacgaagagaaccgcuauauagacaaagagagcggcgaaauaaagcacgccagcaucaagugcaucgcuaaaucacacccccucuaucaagaguuccgccuauggcaauucauagucaaccuccgcauauaccgcaaagaaacggacgucgacgucacccaagaauuacugccaaccgaagccgacuacguuacgcuauucgaauggcucaacgagaaaaaggaaaucgaucaaaaagcauucuucaaauacccgccuuucggcuucaagaaaaccaccagcaacuaccgguggaacuacguggaagacaaaccauacccaugcaacgaaacccacgcccagaucaucacccgacucggaaaagcacacauacccaaagcauuccuauccaaagagaaggaggaaacacuguggcacaucuuguacagcauagaggacaagcaagaaaucgagaaagcccuacacaguuucgccaacaaaaacaacuugagcgaagaguucauagaacaguucaaaaacuuuccgccauucaaaaaggaauacgggucguacucagcaaaagcaaucaagaagcugcucccccuuaugcgcaugggcaaguacuggucgaucaagaacauagacaacgggacgcgaauuagaaucaacaagauaaucgauggagaauacgacgaaaacauccgagagcggguucgccaaaaggccauaaaccuaaccgacauuacccacuucagggcccuccccuuaugguuggccugcuaccuggucuacgaccggcacucggaagucaaggauaucguuaaauggaaaacaccuaaagacauagaccuauaucucaagagcuucaaacaacacucccugcguaaccccauuguugagcaagucaucacagagacccugcgcacaguccgcgacauauggcagcaagucggccauaucgaugagauacacaucgaguuaggcagagaaaugaaaaguccagcggacaaacgagcacgcaugagccagcagaugauuaagaacgaaaauaccaacuugcgcauaaaagcacuccuaacugaauuuuuaaaccccgaguucggcaucgagaacgugagacccuacucuccaagccaacaggaccuacugcgaauuuacgaggaggggguacuaaacagcauccucgaacucccugaagacaucggcauuauucucggcaaauucaaccagacagauacccugaaaagaccaacgcgaucugaaauccuccgauauaaacucuggcucgaacagaaauacagaucacccuacaccggggagaugauaccacuaagcaaacucuucaccccagccuacgaaaucgaacauauuaucccacaauccagguacuucgacgacucucucuccaacaaggucaucugcgagucagaaaucaacaaguuaaaagaccgaucccuaggauaugaguucaucaaaaaccaccauggggaaaaaguagaacuggcguucgacaaaccaguugaaguacucagcgucgaggcuuacgaaaaacuuguacacgaaagcuacucccacaaccgcagcaaaaugaagaagcuacucauggaagauauccccgaccaauucaucgaacggcaacuaaacgacucacgauacauaagcaaagucgucaaaucucuccucagcaacaucgugcgagaagagaaugaacaggaggccaucuccaagaacgucauaccgugcacaggaggaaucaccgaccgucuaaagaaagacuggggcaucaacgacguuuggaacaaaaucguccuuccacguuucauccgucucaacgagcucacagaguccaccagauuuaccuccaucaacacgaacaacaccaugauaccaagcaugccgcucgagcuacaaaaagguuuuaacaagaagagaaucgaccaccgacaccacgcaauggacgcaauaaucaucgcaugcgcaaaccgcaacaucguaaacuaccuaaacaacgucuccgcaagcaaaaauaccaagauaacccgcagggaccugcaaacccuguuaugccacaaagacaagacagacaacaacggaaacuacaaaugggucaucgacaagccgugggagacauuuacccaagacacccucacugcgcuccagaaaauaaccgugagcuucaaacaaaaccuaagagucauaaacaaaacgacgaaccacuaucaacacuacgagaacgggaaaaagauagugagcaaccaauccaagggagacuccugggcuauacgcaagucaaugcacaaggaaaccguccauggagagguaaaccuccggaugauaaaaacagucagucuaaacgaggcccugaagaaaccccaagccaucguugaaauggaccugaagaagaaaauucuagcaaugcucgaacuuggauacgacacaaaacggauuaaaaacuacuucgaagagaauaaggauaccuggcaggacauaaacccuuccaagaucaaagucuacuacuucacgaaagagaccaaagaccgcuacuucgccguacgcaaacccaucgacaccagcuucgacaagaagaaaaucaaagagucgauuacagacacaggaauacagcagaucaugcuacgacaucuugaaaccaaagacaacgacccaacccucgcauucuccccugacgggaucgacgaaaugaaccgcaacauacugauccucaauaaaggcaaaaagcaccaaccgaucuacaagguacgcguguacgaaaaggcggaaaaauucacuguaggacaaaagggaaauaagcgcacaaaauucgucgaagccgcgaaagggacgaaccucuucuucgcuaucuacgaaaccgaagagauagacaaagacaccaagaaaguaauacgaaagcgcaguuauuccaccauaccacuuaacguaguuauagaacgucaaaaacaagggcugucguccgcgcccgaggacgagaacgggaaccuucccaaauacauccucucacccaacgaccuugucuaugucccgacucaagaagaaauaaacaaaggagaagucgugaugcccaucgaccgagaccgcauauacaagauggucgacucaagcggaauaacugccaacuucauccccgcaucgaccgcgaaccucaucuucgcucuaccgaaggccaccgcagagaucuacugcaacggcgaaaacugcauucagaacgaauacgggaucggcagcccccaauccaagaaccaaaaagcaauaaccggggaaauggucaaagagauaugcuuccccauaaaagucgaccgccuaggcaacauuauucaaguagguuccugcauacugaccaacuga

SEQ ID NO: 6919 - RNA, 4575 nt, Artificial Sequence
  Cas9 variant
augaacaagauccuaggccucgaccucggcaccaacagcaucggcugggcgauagugcaaaaggacgaacaagguuuuuacgaaaagaucauaaacgcaggcucccgaauaauaccaauggacgcugaaacaaugaacaacuucaacaaggggauuaccaaaagcccagcguccgaacgcaccagauuccgcggagcccgaagacucaucgaaagaucgcuccuacgaagggagcgcauccaccgacuacuaaacaccaugaauuacuuaccaccccacuacgcagagaaaaucgacuuugucaaccgacucggcaaguucauaggggaagaggaacccaaguacgccuacaaaguagacgaacauggaaaauuccaguucauauucaaggaaaguuucaaugagaugcugaaagacuuccaagacaagcaacccgagcuaguacucaacaacaagaaagugcccuacgacuggacaauuuacuaccucagaaagaaagccuugaaucgggcaaucagcaaggaagaacuaggauggaucauacugcaauucaacaacaagcgcggauauuaccaacugcgaggcgaagaggacgagacguuaacagagggccaaaagaaagaguauuucgcacuuaaagucauccgggucgaggccgacucaagcagcgcuggcaaaaagggagaggucugguacaacguacagcuggagaacggguggauauaccgcugcaaaagcgaaaucccccuagacugggagggaaaaaucaaagaguucaucgucacgacugaagucgaugaaaacgacaacgugcuuaaggacaaagaagguaaggagaagagaaaacucaaaaucccggaggcaggagauuggacccuccugaagaagaagacggaaagcgaccucgacaagagcggaaaaaccgucggagcauacauauacgacacccugcugucuaacccugaccagaaaauaaaaggagggcuaaucaggacaaucgaacgggaacuauaccgauccgagcuagaacaaauacucgacaaacaaaaagaguuccaccccgaacuuaaagacgggacccuuuauaauaaauguguggaggaacuauacaggucgaacgaaucucgaaggaucagucuaucgaacuacgacuucacgcgcuucauaacggaggacguaauauuuuaccaacggccucugaaaucgaagaaaagccuaaucgacaacugcagcuucgagcgccggaacuaucucaacccgauuacgaaggaauuggcguacgcacccauaaagugcauagccaaaagccacccccucuuccaagaguuccgccuguggcaguucauaaagaaccucagaaucauagagcgggaaaagauuguaggggacaagcucauguucgaccaggacgucaccacagaguuccugccgacgcagaacgacuacgucauccuauuugacuggcugaacgaacacaaagagaucgaccaaaaggcccugcuaaaauauccugcguucaaccucaagaaaaacauagacaaguaccgcuggaacuacgucgaaaacaaauccuacccgugcaacgaaacacgagcccugcuaaaggccaaacucaacaaggcagguaauauccccuccgacuuccuagacaaugauacucucgagucccuguggcauauacuauauucagucgaggacaaauucgaaauagaaaaagcacuaaagagcuucgcgaccaagaaagagcuacgggaggaacaaacgguagcauucgucaaacaauucauaaacaucccaccuuucaagaaagaauacggguccuauucagcgaaagcaaucaaaaagcuauuacaacucaugagaauggguagcagauggucagaaaacgagaucagugacucgacaaaagaccgaauacagaagcuaaucgacggagaaugggacgagagcauaaaaacccgaacgcgggacaaagcaauaaaacuaaacgagaucaaugacuuucagggacucccacuauggcuugcauccuacauagucuacgacagacacagcgaauccggcgauguaaugaaaugggaaacaccggaagacauagacuacuaccucaaacacguguucaaacaacacggccuacgaaaccccaucguagaagugguagucgucgagacgcuaaagguuguaaaggaccucuggaaaacauacggcuacuucaacgaaauacacauagaacucggacgggagaugaagaauccggccgacaaaagaagaucgaugacaaacaaaaacauagagaacgaaaacacaaaccuacgaauaaaggcgcuacucgcggagcuggcgaaccacaaggauguggagggcguacgccccuauaguccaagccaacaagagauccucaagaucuacgaagaaggcguccuagacaugcuaaccaaagaagacccggacuacgaaaguaucucgaaaaucagcaaaauggcccuccccagcuccucagaacugauaagauacaaaugcuggcucgaacaaaaauauagaagccccuacaccggccaaguaaucccgcuggcgagacuauucacgagcgaauacgagauugaacauauaaucccgcaaagccgcuacuucgacgauagcuuuuccaauaaagugauuugcgaaagcgccgucaacaaagauaaagauaaccugcuggccuacgaauacaucaaacaaaacgagggcaagaucaucgaaauaggccugggaaagaaaguaaaacucuucaccgcggauagcuacacagaguucguccaaagcaacuacgucggauccguagcgaaaaagaagaaauuacugauggacacaauacccgacaguuucaucaaacgccaacuuaacgacagccgcuacaucucccgcgagauaaugaaacuucugaguagcgucgugagagagaaagaagaagaagaggaagaagaagaagaggaggcaaucuccaaaaacgucaucguuugcacaggggccauuacagacaaacuuaaacgugaguggggccuaaaugaugucuggaacaccaucauuuacccacgauucgagcgacuaaaccaacuaaccaacagcgauaaauucggccaaugggaaaacaaacaggguaagaaagucuuccaaaucgagaugccgcugaaacuucagaaaggcuucaacaagaaacgcaucgaccaccgccaucacgcgauggacgcuaucgucaucgcgugugcaacacaaagccacguaaauuaucucaacaacgaaagugcacacuccaacagcaaagagaaaagauacuaccuaagacgaaaacugcgccgcaucgaaauauuagagaaacaggaacucaaggacggcgucacgaucacaaagaagauugaaguagcgaaggaguucaacaaaccauggccaacguucacccaagacgcucacgaaguacuacagagcauaaucgucagcuuuaaacaaaaccucagaguaguaaacaaagcgacaaaccgcuacgcgugcuucguaaacggaaagaaagagauagucaaacaaagcaaaggggaauccugggcaauacgaaaaccgaugcauaaagacaccguauccgccgcggugagccuaagaaagaucaagacggucucccucagccaggcgauagacgacuggacaaacaucguugacaaaagccuacggaaggagaucggccuccuauacagcaaauacggccagaauggcagcaagaauaucaucaaauacuucaaagacagagacaacaagcacaacggacuagacguaucaaaaguaaacguccauuacuucgacaaugacuacgcggcaagccgcgucgcgcuagaccauaaguucaacagcgcuaaaauaaagucaaucacagacacaggaauccagacgauacuacucaaacacuuggaguccuacaacgaaauaaauggcgacaagauaauagagcaccccgagcuagcauucuccgccgacggacucgacauccucaacgccaacauaacgaaacucaacaacgggaaguuccacaaacccaucaagaaaguccggaaaaccgagacccucggucucaaauucaucguuggacagacggggaauaagcgaaagaaauacguagaggcagccgacggaaccaaccuguucuucgcaaucuauguaucaguagauggcauuagaucguacaaaaccauaccacuacgagaaguagcagaacgccuaaaggagggccugauccccguacccgagaagaaugauaaagacgaccaucugcuauuuuggcugucgccaggcgaccuagucuacgucccgagcauugaagaggaaggccgcauagucgaaaucgaaaacaucaaacaggaccgcauauacaaagucguaagcugcacagagaacgaaugccacugcauaccgcacuuuguggcaagucccaucguaaagacagacgaauugggagcuaacaacaaggcccaaagggcauggagcggggaaaugauaaaggaaacuugcauaaaaauaaagaugaaccgacucgggcagauagucaagauauga

SEQ ID NO: 6920 - RNA, 4581 nt, Artificial Sequence
  Cas9 variant
augaagaaaauccuaggacucgaccuaggcaccaacucgaucggaugggccguccucaacgcagcagacgacaauucacugaaauacauagaggcagcgggcucccgcaucauacccauggacgccgcaaucuuaggcgacuucgaucgaggcaacucgaucucccaaacggccgagcgaacgcguaucagaggaaugcggcaucuccgcgagagguaucuccuccgccgggcgcggcuacaccgcauccugaaccuauugggguuccugccuuuccauuacgcacaagacauagaccgcuacggcaauuucagcgccgacauggaacccaagaucgccuggcgcaaaaaccuggaaggagagcuggaguucauuuucaucgaauccuucaacgaaaugcucgaggacuuccgaaagaaucaacccgaacucgucgcagacaacaaaaaggugccuuacgacugggucaucuacuaccuaagaaagaaagcccucgagaagaaaaucagcaaagaggaacucgcauggauccucuuaaauuucaaccagaaaagaggguacuaccaacuacgaggagaagacgacgacgagucgaugaaaacugccaaaaccagacaauacuucgacaaacaaauuaucaaaaacaucaucgacacgaaccaaacuuacaaaggccaaaggauccucaucgucgaacugcaaaacggagacaagggcaagauauucaagaaagaaaucccggacuggauaggccaagagaaaaacauaauaguaaccgucgauauagauaaagacggcaacgacaaauacgaagagagcggaucccuuagcugccgcuucaaaaucccgacugacgcggaaugggaaucagaauggaagcucaucaaaaugaagacgcaaaaggaccuagaugaauccaacaagacggucgggaccuacaucuacgacagcauacuacagaaccccacccagaaagugcgcggcaaacuuguccgcacaaucgaacggaaguacuacaaggcagaacuaaagcaaauccuagaaaaacaaacggaguuccauagugaacugcaggauaaggaucucuauauagagugccugaacgagcuguacagcaacaacgacacccaucgaaacgccaucaccgacagagacuucgucuaccuguucaugaacgacauacucuucuaccagcgaccgcuaaagagcaagaaaucacugauagacaacugcccguacgaacgcaacaucuacaucgacaaagaaacgggggagaucaaauacagcccgauaaaauguaucgccaaaucgcacccccuguuccaagaguuccgccuuuggaaguucaucuccagcauccgaaucuaccaacgagaaagcguuguagaaguggucgacaaacaacucgaucuguuuagcucgcagagcaccucaguacagaaacucgucacggacguagacgucaccgacaaauuccuaacuugcgaaaacgacuacgucgcccuauucgaauggcuaaacaaaaagaagaucaucgaucaaaaggaguucuugaaauaucgccccuucggccuuaaaggagacauugauaacuaccgauggaacuacgucgaagacaaaagcuaccccugcaacgaaacacacgcaaugauccuaacguacuucgcaaaggccggaauaagcgaagauauccucaccaaagaaauggaagaggcccuauggcacaucuuauacagcguagaagaccgacaggaaauaacuaaagcccuacgaaccuucgccagcaaauaccaccuuagcgauucguucguuaaaguauuuucaaacauacccccauuuaagaaagaauacggcuccuacagcgcuaaagccaucaaaaaguuguuaucccucaugagaaugggcaaguacugguccgaggacgccauagacguaaauacacgcgaacggauagacaaaauaguaacaggagaauaugacgagaagauaagagaccgcguccgcgagaaaaccauccgccuaaacgacaucagacacuuccgggcccugcccgacugguuagcaugcuacgucgucuacgaccgccacagcgaaacccgcgaaaucaccgaauggaaauccccugaagaaaucgacgaauacauacgaaacuucaagcagcacucauuacgcaaccccaucgucgaacaggugaucacagagacccuaaggacaguacgagauaucuggaaacaagucggcugcauagacgagauccacgucgaacuaggcagagagaugaaaaacccagcugacaaacgcaagcgcaucacgucacaaaucaucgagaacgaaaacgcaaaucuuagagugaaagcacuccuaacggaguucgucaaccccgaguucgaaaucgaaaacgucaggcccuacagccucggacagcaagacauacuucgcauuuacgaagaugguguucuaaacuccguagcggaagugccgggagacaucgccgggauucucaagaaauucaacgaaaacgacgccaagaaacgcccaacuacaucggaaauacucagguacaaacucuggcucgaacaaaaauaucgaucgccuuauaccggagaaaugauaccccuguccaaacuauucacaucagccuacgaaauagagcaugucauaccgcaaagccgcuacuuugacgacucauucucgaacaaaguuauaugcgaagcugagguuaacaaacucaaggacaaugcgcuuggcuacgaguucaucaagaaacaccacggggaaaaagucgaacucggcuuugggaaaauaguggaaauauucaguguaucagucuaugaacaauucgugaaagacaacuacucgcggaacagaggcaaaaugaaaaagcucuuaauggacgaaauacccgaacaauucaucgagcgacaacucaacgacagccgcuacauuuccaaagucguaaaaacccugcugucgaacguaguacgcgaaaaggcggaacaagaagcggugucgaagaacguaaucgugugcacaggcggcguaaccgaccggcucaagaaagacuggggcauaaacgacguuuggaacaaaauaguacucccccgauuccuccgccucaacgaacugaccaacuccaccaacuucacagccaaaaacgccgccggcaacgaaauacccgccaugccacuugaacugcagaaaggguucaacaaaaagaggauagaccaucggcaccacgcaauggacgcaauugucaucgccugcgccaaccgaaacaucgugaauuaccugaacaacgagagcgccagccgaaaagcgaagaucagccgccacgaccuucaggcgauucugugcgacaaaguucgaacggacgacaaaggcaauuaccaguggcgcgugaagaagccaugggauaccuucacacaagacgucuacgucgcccucgaaaacauaauuguaaguuucaaacaaaaccuucgcguuauaaauaaaaccuccaacuacuacuggcauuacgaaaacgguaaaaaggugcugguuaaacaagucaagggagacuccugggcaauacgcaaacccaugcacaaggacacgguauuuggagaaguaaacuugcgcaaaguaaaauccgucagucuaaacgaagcccucaaaaacccccaauucaucguagaaaaagaccuaaaacgacaacuccucucccuacuccaacaaaacuuugauauaaagaaaaucaaaaaguacuucgaggagcacaaagacauauggucagacaucagccucaguaaaaugaauaucuacuacuucaccaaggaaacaaaagaccgauacuucgccaccagaaaaccacucgacgcaucauucgacaagaagaaaauagaaagcugcauaacagacaccggcauccagcaaauucuacuccgacaccucgaacuaaaagaaaacgaucccgagcgcgcuuucagcccagacgguauagacgaaaugaaccgaaacaucauacaacuaaauaaagggaaaggccaccacccaaucgcgaagguacgcgucuacgaaaaagcggacaaauucgaaguaggccagcgcggcaacaaaucuuccaaguucgucgaagcggccaaggggacuaaucuauuuuucgccguauacgaaacagaauaccccgacgagaaaaccaacucgaucguccgaaaaaggaacuacgccaccauaccgcuaaacaucgcgaucgaaagacagaaaagaggucucucgaccgcgcccgaagacgagaaaggcaacguccccagcuucguacucucaccaaacgaccucgucuaccuaccgaccuccgaagacaucgugaacgggcacauaacacaacccauagacaaaagcagaaucuacaaaaugguuucaucaagcgggucccaaugcuucuuuauaaaacacaauaucgcaaauaucauuguagacaaauacgaguucuccccgcuuaacaagauggaaagagcaauauccaacgagaugauaaaagagaucugcauacccguaaaagucgaucgccugggaaauauaguaaaacuggggaagucugaguga

SEQ ID NO: 6921 - RNA, 4581 nt, Artificial Sequence
  Cas9 variant
augaagaagauccucggccuagaucugggaacaaacagcauugggugggccguacuaaacgccgcggacgacaacucacucaaguacaucgaggcagcaggcagccgaaucauacccauggaugccgccauacucggggauuucgaucggggcaauagcauaucacaaaccgccgagagaacacgaauacgaggcaugcgccaccucagggaacgguaccuauugaggcgcgcccgccuacaccgaauccuaaaccuacucggcuucuugccguuccacuaugcacaagacauagaccgguauggaaacuucagcgccgacauggaacccaaaaucgccuggugcaaaaaucucgagggcgaacucgaguucaucuucauugagucauucaacgaaaugcucgaggacuuucggaaaaaccaacccgaacuggucgccgacaacaaaaaggucccuuacgacugggucaucuacuaccuaaggaagaaagcccuagaaaagaaaaucagcaaagaggaacucgccuggauacuacugaauuucaaccaaaaacgaggauauuaccaacuccgcggcgaggacgacgacgaaucgaugaaaaccgccaaaacacgacaauacuuugacaagcaaauaaucaaaaacauaaucgacacgaaccagaccuacaagggacaacgaauccuuaucguugagcuucaaaacggagacaaaggcaaaaucuuuaagaaggaaaucccagacuggauaggacaagaaaagaacaucaucgucaccguagacaucgacaaagacgggaacgacaaauacgaggagucuggcucccucagcugccgcuucaagaucccaacagacgcagagugggaaucagaauggaaacuuauaaaaaugaagacccaaaaggacuuagacgaaucaaacaaaaccgucggcaccuacauauacgacucgauucuccagaacccaacccagaaagugcgcgguaagcuggugcgaacuauagagagaaaauacuacaaagcagagcuuaaacagauacucgagaagcaaacggaguuccacucagaacuacaggacaaagaccuuuacaucgaaugucucaacgaacucuacuccaauaacgacacccaccggaacgcaaucacagaccgcgacuucguuuaucucuucaugaacgacauacuguucuaccaacgcccccucaaaucaaagaaaucgcugaucgacaacugcccguacgaacgcaauaucuacauagacaaagaaacgggcgaaauaaaauauuuaccgaucaaaugcauagcgaaaucacacccacucuuucaagaguucagacucuggaaauuuaucuccucaauccgaauauaucaaagggaaagcgucguugagguaguagacaaacaacucgaccucuucuccucacaaaguaccagcguccaaaagcucguaacagacgucgacguaaccgacaaguuccuuaccugcgaaaacgacuacguagcccuauucgaauggcuaaacaagaaaaagaucaucgaccagaaagaguuccucaaguacagacccuucgggcuaaaaggcgacauagacaacuacagauggaacuauguggaggacaaaucguacccaugcaacgagacccaugccaugauccuaaccuacuucgcuaaggcaggaaucucagaggacauacuaaccaaagaaauggaggaggcccuuuggcacauacuguacaguguagaggaccgucaagaaauaacuaaggcacucaggacuuucgcaagcaaauaucacuuauccgacucguucgucaagguauuuucgaacauuccaccguucaagaaagaauacgggagcuacuccgcaaaagccaucaagaagcugcugagccugaugagaaugggaaaauacugguccgaggaugccaucgacgucaacacaagagaaaggaucgacaaaauagucaccggcgaguacgacgagaaaauccgggaccgaguacgggagaaaaccauucgacucaacgacauccgccacuucagagcucugcccgacuggcuagcuugcuacgucguauacgacaggcacagcgaaacgagagagauaacggaauggaagucccccgaagagaucgacgaguacauacggaacuucaaacaacauucgcuccggaaccccaucguagagcagguaauaacugaaacccugcgcacagucagagauauauggaaacaagugggguguauagacgagauacacguggagcuagggcgggaaaugaaaaaccccgcggauaaaaggaaacgcaucaccucucaaaucauagaaaaugaaaacgccaaccuacgagucaaggcgcuacuaaccgaguucgucaacccagaguucgaaauagaaaauguccgacccuacucacuaucccaacaagacauacuccgcaucuacgaagacggcgugcugaacagcguagccgaagucccaggagacauugccggaauccugaaaaaguuuaacgaaaacgacgcuaagaaacgcccuacaacaagcgaaauccuacgauacaaacuauggcuagaacaaaaauacagauccccauacacgggcgaaaugauaccgcucuccaaacuguucaccagugcguacgagauagaacauguaaucccccaaucaagauacuucgacgacucauucaguaacaagguaauaugcgaggcagaagucaacaagcuaaaagacaacgcgcuaggcuacgaguucauaaagaaacaucacggagaaaaagucgaacucgguuucgggaaaauagucgaaaucuuuuccguaucgguauacgaacaauucgucaaagacaacuacucaaggaacagaggcaaaaugaagaaacuccuaauggacgaaauucccgagcaauucauagagcgccaacucaacgacucucgcuacaucaguaaagucgucaagacgcuccuaagcaacgucgugcgcgaaaaagcagagcaggaagcagugucaaagaacgucauaguaugcacgggcggaguuaccgaccgacucaaaaaggacuggggcaucaacgacgucuggaauaagauaguacuaccccgcuuccugcgccucaacgagcucaccaacucuacaaacuuuaccgcuaaaaacgcagcggggaacgagauaccugcaaugccauuagaacugcaaaaaggauucaacaagaaacgaauagaccaccgacaccacgcgauggaugcaaucguuaucgcgugcgccaacagaaacauagugaacuaccucaacaacgaaagcgcaagccgaaaagcgaaaauaagccgccacgaccuccaggcgauacugugugacaaagucaggacagaugacaaaggcaauuaccaauggaggguaaagaaaccgugggacacuuucacacaggacguguacguagcacuagaaaacaucaucgucaguuucaaacaaaaccugcgagugauaaacaaaacuagcaacuacuacuggcacuaugagaacggaaagaaaguccuggucaagcagguaaagggcgacucgugggcaaucagaaagcccaugcacaaggacacagucuucggcgaagugaaucuacguaaagugaagagugugucucuaaacgaagcccucaagaacccccaguucauaguagaaaaagaccugaaacgccaauugcuaagccuccuccaacagaauuucgauauaaagaaaaucaagaaauacuucgaagaacacaaagacauauggucggacauaucccucuccaagaugaacaucuacuacuucacgaaggaaacaaaagaccgauacuucgccacacgcaaaccgcuagacgccagcuucgacaaaaagaaaaucgaaagcugcaucacagacacagggauccaacaaauacugcugcgccaucucgagcucaaggaaaacgauccagagcgcgccuucucgcccgacggcaucgacgaaaugaaucgcaacaucauucagcucaacaagggaaagggccaucaccccaucgccaaaguacgaguauacgagaaagcggacaaauucgaggucgggcagcgcgguaacaaaagcaguaaauucguagaagccgcaaaaggcaccaaccuauucuucgcaguauacgagaccgaauaccccgacgagaagaccaacucgaucgugcgaaaacggaacuacgccaccaucccccucaauaucgcaauagagcgucagaagcgaggacucucaacugcgccagaagacgaaaagggcaacguccccagcuucguccuaucccccaacgaccucgucuaccucccaaccucagaagacaucguaaacgggcacauaacacaacccauagacaaaagucggaucuacaagaugguaucguccaguggcucacagugcuucuucaucaagcacaacauagccaacaucauagucgacaaguacgaguucagcccacugaauaaaauggagcgcgcaauaucaaacgagaugaucaaggaaaucugcaucccggucaaggucgaucgccugggcaacaucguaaagcucggcaaaagcgaauga

SEQ ID NO: 6922 - RNA, 4584 nt, Artificial Sequence
  Cas9 variant
auggccaagauccuaggacucgaccuggggacaaacaguauaggcugggccauaguagagaaagaugggaaugacuucucgcuaguagacaaaggcgugcgcauauucucagagggcguaaaguccgaaaaaggcaucgagagcucaagggcagcagagagaaccggcuaccguagcgcaagaaagaucaaguaucgccgcaaacuccgaaaguacgagacgcugaaggugcuaucacucaacgggaugugcccccuaucaaucgaagagguagaggaguggaaaaaguccggcuucaaagaauauccacucaacccugaauuuuuagaauggcuaagaacaucggacgacgaaaacaucaaccccuauuucuuccgagauaaggcauccaaacagaaggucacccucuuugaagucggccgcgcguuuuaccacaucgcccagaggcgaggguuccugucgaaccgacuggaccaaagugcggaaggcauacuagaagaacauugccccaagaucgaagcccuaguagaagaccugaacucaaccgacgagauacuaaccucccuaaaggacuacuucuucgacacaggcauucuggacgccaacgaaaaaggaggcuucgccaaagaccucgacgagggcgacaagaaacuggugucgcucuaccgauccauccaagcaaucgugaagaaaaacgacaccgacuucgaaaagggaaaggccgaaaucaucgagcgucugaacaagaaagacguacugggaaaggucaagggaaagaucaaagauauaucacaggccaugcuagaggguaacuucaaaacccucggucaauauuucuucagccucuauaacaaagaacgcauucgaaaccaguacacgucaagggaggaccacuaccuagaagaguucaaaaucauaugcaaauuccaaggaaucggaagcaucaaucaaaacgagaaacugcccgagaaaaaguuugaagggcuagcgaaagaacuguacaaggccauuuucuuccaacggccgcucaaaucccaaaaaggacuuaucggaaaaugcagcuucgagaaaucuaagagccggugcgcgauaucgcaccccgacuucgaggagaagcgcaugugggaauaccugaauaccauuaagauaggcacacaguccgaaaaaguucugcgcuuccuaucacaagaggagaagcucaaccucauaccuaaauuccugaggaagaaagacaacuucaacuucgaagaccucgccaaagaacuaauagaaaaaggggccacauuuggauucuacaaauccagcaaacgugacuccuuccacuacugguucaacuacaaacccacggauacggucagcggcugcccggucagcgccucacuaaaaucaguugugggggaagacuggaaaaccaaaucguucauuuacaaaacaacaaacuccaagggaauugagguaucacgaacagugaacuacaaggaccuguggcaucugcuaagcgucuccaccucugacauauacuuauaugaguacgccaagaacaagcucggacuggaagauaaaaacgccaaagcguucucaaagauaaagcuaaagaaagauuuuggaaaccucucccucaacgcgaucaacaaaauccucccguacaugcgagagggguuacuauacucacacgccguauucauggcgaacauagaauccaucguagaugaggucaucuggaacgaccuagggcaacgaaaguacauccaagauaagaucgcagccaucauagcaaacaacaucguagauaauggacuccuggaagucgucaacggacucaucaaagaguguaaaguagauggcgcauacuacagcaaagaggccgccgacacauacaggaaggaccucuccaagaagcucguauccuucuucaaauuccaccacaucgacgacggcauaaagcaagagacaauccucaacgaacucuucccagucuucauugagcaacucaaggcccacgaguucaucaaaguaaagcggcucgacgaaaaagugcucgaguuccugaaaggggaaaaucaagauggagaaguauucugcaacaacgcaaaacaacuaaagaaacuguaccauccauccgacaucgaaguuuucaagaaacagaucgucaaagacaaagaugggaccgaaacgggccagcucauacugggcagcccgcuaaccagcuccaucaaaaaccccauggcaaugcgagcccuucaucaacuccgaaaaguccucaacacccuuaucguagaggaacaggucgauucaaguacccggauacacauugaaauggcccgcgaacuaaacgaugcgaacaaacggaaaggcauccaggacuaccaaaacgaaaacaagaaagaacgcgagaaauacagggacgaaaucaagaaacucuaccucgcggaaugcaauaaagaaauugaacccacaguagacgaccugcuaagguaccagcucuggaucgagcaagaccgaaaagaaaucuacgagaacgggaacuccaucuccauaugcgauaucauaggcgacaacccugcguacgacauagagcacacuguaccgcgaagcaucucccaagacaauucccaaaugaacaaaacccucugcagccaaaaauucaacagggacgugaagaaacagaaaaugcccuuugagcugggcaaccaucuggagaucuugccaaggauagcccauuggaaagaagaagccgacaaccuaucccgagagaucgagaugaucauacgcucaaccaaaacagccgcuacaaaagaggcaaaagacaagaaaauacgccggcgacacuaccucacgcugcggcgagacuacuugcaaggcaaauacgaccgcuucaucuggaccgagccaaaaguuggcuucaagaacucgcaaauccccgacaccggcauuauaacccgguacgcccaagcauacuuaaaaagcuacuucaaccgaguggagucagucaaagggggaaugguggcggaguuccggaaaauaugggguauacaagaaagcuaucaagagaacgggaaaaaguacuucaaagagaaagaucgaucgaaacacacgcaccacacgauagacgcaaucaccauagcaugcaugacgaaagacaaauaugacguccucgcccacgcauggacccuagaggacaaagagcaaaucaccgaagcccggaaaaucgucgccgaguccaaacccuggaaaaccuucaaagaggaccuaaagaaaaucgaggaaggcauccucguaucccacuauaccccagacaacgugaagaaacaaucaaagaaaaucguccgcguucguggccggaaacaguacgucgccgagaucgagcgcgacguaaacggaaaagcuguggcaaagaaggacaucagcgguaaagugaucuacaaacuugacaaggacggcaagaaacuaccgcggcuacaacaaggcgacacaauccggggaagucuucaccaggacagcaucuauggcgcgaucaagaacccacucaaaaccgaggagauacgauacgucauccgcaaagacuuggaauccauaaaagcuagugacgucgacaacauagucgacgaaaugguaaaagaaaaagugaaagaagcaauagccuccaaaguccuuauccucucgucuaauccccagcagaaaaauaagaucgacggcaaagucuggaugaacgaggaaaaagggaucccaauaaacaagguccgccuuuacgcgaacagcgucaaaaacccccucgagauaaaggaacauagcucacucagcaaaucacgccacgaacacaaacaaaaaguauacggacagaacgacgagaacuucgccauggcaaucuacgaagggcuugacaagaagggaaagacggaacgagcauucgagcucauaaacuacauggaugccgguuacuacuacaagcuaaagaacaaaaaugagaggaaaaaggacaucauauccuuagucccugaaaaacacaucgaaaccggguucaaucuacugcggucgaacaaaaucccaauaauccugaagaaaggccucaacgucauccuauauaaaaaugaaaaagaagagaucgauuuuaacaacccaaauucgaucaucaaaagacuauauaagauaagcgggcuagacaaagauggaaucaaacuaauguacugcaucagcgccaagggaucaaccgaaaacaucgcguacaugaaugacgucaucaacaagcagaagcuauucgaacuaaaaucagaaauggagaaacuggggcuaugggacaaaguauucagcgacuuuaagaacgacaaccugaaaaaguccgacuuuuucaagaaauuaaacgaccuacuuaacaagcacuacuuugagaacaacgucugcgacagcaucggaaguaucaagaaggucaaaaucaaggagaguggccuaacgaccccuaaaggcggugacgugauagacaacuucaaagacuucccauacaucaaguucaaaguaagcaacuuuaaugcacucauagaaggaauugacuucaaaauuuccccaaccggcaaguucguacaaaucuga

SEQ ID NO: 6923 - RNA, 4587 nt, Artificial Sequence
  Cas9 variant
augaaaaagauccuaggacuagaccucggaacgaauagcauaggaugggcccugguggagcaggacuucaaaaacaagcaagggaauaucaugggaauggguucacgcguaauccccaugucccaagagauucucggagaauuugcacggggcaauacgaaaagcgagacagcggagcguacccgccuacggagcgugagacgacuacgggagcgccaccucuuaagacgcgaacggcuacaucgcguacuccacauacuaggcuuccuacccaagcacuacguaaaccaaaucgacuuccaggaacgacuaggaaaauucuucgaagaaagcgaaccgaaacuagcauacgauaccggggacuuucucuuuaaaccaucuuuccuagagaugcuugaagaguuuaagauacaccaacccucguucgucgaaggcgauaaaaagguacccuacgacuggaccauauacuuucuacgcaagaaagcccuaacagagcggaucgaaaaagaagaacucgccuggguaauccugaguuuuaaccagaaacguggauauuaccaacuacgaggcgaggaugaagaagaaaagcccaauaaacuugaagaauuuuacucgcuaaagaucgucgacauaaaagucgacgagucaccgaacaagaaaggggacaccugguacucacucacccucgaaaacggcuggaucuaccggcgguccucuaaagucccccuggaugauuggcucgggaaaacaagggacuuuaucgucacgacagacauagaugaagaaggcaacccgaagcuggacaaagagggaaacccgaagcgaucuuuucgagccccaucggaagacgacuggggccugaggaaaaagaaaacagaaaaagaaauccuugacagcagcaaaaccgucggacacuucauauucgagaaucugcuagccgaccccacccagaaaaucaaaggacggcucguacgaaccauagaaagaaaauuuuauaaggacgagcuaaaacaaauacuuguaucgcaaaaccgcuuccauccagaacuauccgacgccgauaugauggcugauugcgugcgcgaguuauacaaacacaaccauucucaccaaaacuuccucgcaagcaaagacaucaaacaccuccucgucgacgacaucauauucuaccaaagaccucuccgaagccagaaaagcacaaucggcaauugcccccuugaguucaaaacuuuuaagaaagacggaaucgaaaucaaaguccccuauaaggucgcgccaaaaagccacccucucuuccaagaguuccgccuccuucagugggucuccagcuuaagaaucauccggaagucugacgacucagacguaacccgcgaauuucucgggacccaagacaagaccaagcaacugcuggacuaccugaugacccagagcgaaauggacugcaacaaacucaugacuuuccuacuuacacaagaaggauacaagagaaaggaccuaaaaagcgaaguuggcaaauuccgguggaacuacguauucgacuccgaaacgggcgaaucaaaaacuuacccaggaaacagcacgcgagccgaguuccucaaaagauugggaaaggucgaaggguucgacuucagcaaauacaccgaagaauuugaggaaucacuauggcaccuggucuacucggucacugauaaaguagaauuugagaaggcgcugcgcaaauucucaaggaaaaaugggauagaaaucaacuccuucguagaaaaccugaagaaauuucccccauacaaaagcgaauacgccagcuauucccuaaaagcaaucaaaaagcuauuagcccucaugagauuuggcgaaaacuggaaggaagauucgauagacagcaucagcaaacacagaaucgagaagauucucaccggcgaauaugauccggaaauaaaggauaagguccgggagaucucaagggcguucgacgaaguagaggacuuccaaggccuuccagugugguucgcgaacuacguaguauacggcagacacucugaagcauccgaauuaaucaaauggacaagcuccgacgaaauggccgacuucaucaaggaguucaaacaacacagccuccggaaccccaucgucgaacaagucguacuggaaacccuuaggguuguaaaagacaucugggacaaauacggacacggucagaaagacuucuucgaugaaauccacguagaacuaggacgugaacucaaaaaccccgcagaacagcgagcccgccuaacaacacaaauaucugcaaacgagaacaccaaccuacgcaucaagucccuccucguagaacuacuccacgacccaggcgucgaaaacguccgucccuacuccccaaugcaacaagagauccugaaaauauacgaagaaggagucuuaaaaagcaguuucgaaguacccgacgacauauuaaagauauccaaaacagcccagccauccucaagcgaucuaaagagauacaagcuauggcucgagcaaaaguaccgaucucccuacaccggaaagaucauaccgcucaacaaacucuucacccccgcauacgaaguugaacacguaauuccccagucacgcuacuucgacgacagcuucagcaacaaagucaucugcgaagcugcaguuaacaaacuaaaagacaaccgacugggaauggaguucaucaaaugcuuccacggccaacgagugucacucggcuucggggaagaagucgaaaucuucagcgagucugcauauaaggcuuucauccaggacaacuucccaaagaaccccgcaaagaaaaggaagcuccugauggacgagcuacccgagcaaaugguggaacggcaaaugaacgauacacgcuacauaucuaaauucguaacuuccauacucuccaauaucguccgcagcgaggaaaaugacacgggcuucaacucgaaaaacauaauccccggaaacggcaaaaucacaaccgcccugaaacaagacuggggacuaaacgaugucuggaaugaacuaauccucccgagguucgaaaggaugaaccaacuaaccggcacaaccguauucaccgccuggaacgaaaaucaucaaaaauuccuaccgacuguaccccucgaauacgcgaaaggguuccaaaagaagcgaaucgaccauagacaccacgcaauggacgcacuggugaucgcgugcgcaacgcgagaucacgucaacuacuuaaacaacgaacacgcgcucggcaagaacuacaagggcaaggaagaaaaacaaagccgcagguuugaccuacgccaaaagcucugccucaaaaagaaaaacggccacucacaggagcaauaugaauggauauuuuccaaaccaugggacaguuucacucaagacgccaaaaagaaccuagagagaaucaucgugagcuucaaacaaaaucugcgggucaucaacaaaacaagcaacaaauaccucagcuacaaggaugaggagggaaaccuuagacuggacucccaggggaagccagucaaagcacuuaccaggcaaaucaagggcgacgccugggcuauuagaaaaucgauacauaaagacaccgucagcggccuugugaaacucagacgcgucaaaaugguaaaccuaucggucgcucuggacaacccggaaaacauccuaaacaagaaacuaaagaagaaaaucgcagaacucguaaaacugaacuaugacaacaaacuccuacuaaaauacuuccgcgaccgcgacuacauguucgacggacgcgaggucuccaaauuggacgucuacuacuucgaggagggacuugcagcaagcagggucagucuagacaccagcuucagcgacaagaaaauccaauccaucaccgacaccgggauaagaaaaauccuacuugcacaccucgccaacuaccacggccgccuagacgaaaaagguaaagucauaccacccgagacacuggccuucacacccgaaggaauagaagaacucaacaagaacauaaaaggccuaaacggcggcaaauuccaccagcccauauucaaggugcggaccuaugaaccgaagggcaacaaauuccaggugggcuucaaaggcaauaaaaacucaaaauacgucgaagcugcaaagggcacaaaccuauuuuucgcaaucuaccucaaugaugaagguaaacgaagcuacgaaacaauaccguucaacguugugauggagcgccuaaaacaaggcgaaggaccagucccccagaccaaugagaagggcgggaaacuccucuuccaccuaucacccaacgagcucgucuacgucccagaaaccgacgaaaacuacaccaacgucgacuuuaagaaccucucuaaggaacagguugaaaagauauacaaaaugguaucgagcacaggauccgaaugucauuucguccgcgcggacauaagcucacuaaucaaaggcuaugacgcaaaaaccaaagugggggaacucggcucacucaacaaacaagagguuacaaauaacggcaugacacgcauuaaagaaaagugcuggaaaauuaaaauugaccgacuagggucuaucuga

SEQ ID NO: 6924 - RNA, 4587 nt, Artificial Sequence
  Cas9 variant
augaaaaagauccuaggcauagaccucggaacuaacucuauugguugggccguagucaacucguuugacgaaaaccagaacgaggaaucucuaaaacacauagaaugcgugggcuccagaaucaucccaauggacgcggccauccuaggagauuucgacaaaggcaacucuaucucccagacagccaaacggacugaguuccgcagcguaagacaucugcgggaacgucaccuccuccgcagggcgagguuacacaaaauccucagccugcucggguuccuccccgaccacuacguucaagaccuagacagccacggcaacuuccccgucaaugucgaaccaaagaucgccuggcguaaagacuccaacggcgcauucgaguucaucuucaaugacuccuuugacgaaaugcugcaagacuucgcaaccuaccaaccagagcucauagcauguaacaaaaagguaccauacgacuggacaauauacuaccuacgaaagaaagcgcuaaccaaaaagcucuccaaagaagaacugucauggauucuacuaaacuucaaccaaaaacgcggcuauuaccaacuccgaggagaggaagaugacgaaucagucaagagcgccaaaacacgacaguacuuugaccggcagaaaauuaaguccauaguggacacgaaccaaacauacaagggccaaaagguacugaucgucgaacuagaggacggcaucaaaggcaaaauuuuuaaaaaggagauccccaauuggguaggucaggagaaaagcaucaucgucacaauagacaucgacaaagauggaugcgacaaguacgaagaaucaggggaacucucgugccgguucaagaucccguccgacgcagaaugggagucagaauggaagcuaaucaaaaugaagacccagaaggaccuggaugccucuggaaagacaguuggugcguauauauacgaugcuauccuccaaaacccaagccagaaaauccgcggcaagcuagugaggaccaucgagagaaaauacuacaaagaagaguuaaaacagauccucaagaaacaaguugaguuccacccagaacuaagagacaaagaccucuuccucgauugccucaacgaacucuaccccaacaacgacgcccaccgcaacgccugcgccgaccgcgacuucauauaucuauucauggacgauauucucuucuaccaacgcccgcucaaaagcaagaaaagccuuauagcagacugcccguacgaaaaacacauguacagagacaaagaaaccggagaauuaaaauauaguucaguuaaaugcaucgcgaaaucucacccacuauuucaagaguucagacucuggcacuucauauccaacauaagaaucuaucaaaaggaacgagucgucgacguagacgcagaccaauccgcccuuucgagcgcccgaagcgcccucaagucgaaauuagaagccgacguggacgucaccaaugaguuccucacaugcgaggcagauuacgucagccuguucgaguggcucaauaauaagaaaagcgugucccaaaaagacuuucuaaaauaccccgccuucggcauaaagaaaagcggagacaacuaccgcuggaacuacgucgaagacaaaagcuacccaugcaacgagacccgagccuuaauccucagccaccucgaaaaggcaaacauaaggggagacauauuuacccgagagcaagaagaagcacuauggcauauccuauacucggucgaagaccguuacgaaaucguaaaagcacugcagagcuucgcagcaaaauacagguuuaacgacgacuucguaacaguuuucucaaaauuucccccguucaagaaagaauacgguuccuacagcgccaaagcgauuaagaaacuucucccuuuaaugcgcaugggaaaauacuggagcgaagccgcaauagacaucaaaacgcgugagcgaauagagaaaauaaucaccggcgaaugcgacgauagcauacgcgaacgaguacgccugaaagcgauucggcugcacgacaucggagacuuccgugcacugccaguaugguuggcaugcuacgucguguacgaccgacacucagaguccggcgacaucacuaaauggaagaccccgcaagaaauggauugguauauccaaaacuucaaacaacacucccucagaaaccccaucguagagcaagugauaaccgagacauuacgaguaguacgagacaucuggaaacagguaggccggaucgacgagauccacguagaacucggaagagagaugaaaaacccagcagacaaacgcgccaagaugaccgccagaaugaucgaaaacgaaaacaccaaccuccgcaucaaagcaaugcuaaccgaauuucucaacccggaguucgaaaucgaaaacgugaggccauauucggcaucacaacaggacauccuacgaaucuacgagaacggcguauuaaacagcgugucagaaaucccggaggagauuaccggcauucuaaagaaauucaacgagcgggagcaaaggaaacgcccauccaccuccgaaguccuacguuacaaacucuggcuugaacaaaaauacagaagcccguauacaggcaaaaugauaccccucgggaaacuguucaccccagcguacgaaauugaacacauaaucccacagagccgauacuucgacgauuccuucaacaacaaaguaaucugcgaagccgaaguaaauaagcugaagggaaaccugcuaggcuacgaguucaucaagaaacaccacggacgccgaguggaccucggcuuaggcgagaucgucgacauauucuccgucgacgaguacgaaaccuucgucaaagauuauuacagcgcuaaccaacagaaaaugaagaagcuacugauggacgagauaccggaacaauucaucgaacgccaacucaacgacucccgauacauaagcaaggucguaaaaagccugcucuccaacaucgugcgcgaacaagacgagcaagaaucgauuucgaaaaaccucaucgucugcaccggcggcgugaccgacagacuaaagaaagacuggggcaucaacgacgucuggaacaaacuuauccugccccgauuccagcgacucaacaacaucaccgagacaaccgaguucacugcgaaaaacaugcaaggccacgagauacccguaguccccuucgaauaccagcgaggauucaacaagaaacgcaucgaccaccgacaccacgcaauggacgccauugucaucgcgugcgccgggcgcaacaucgucaauuaccuuaacaaugaaucugcccgcaagaaagcccaaauuucgcgauacgaucuccaacgacuccucugcgacaaagugaaaacagacgacaacggcaacuacaaauggauucugaagaaacccuggagcacccuaacccaagacguauacgcggcccuugacaacguaauagucucguucaaacagaaucucagaguaauaaacaagaccaacaaccacuacguccauuacgaggcgggaaagaaaaucaucgccaaacaagagaaagcgaguugggcgauacgaaagccaaugcacaaggacaccgucuucggcgaggucaaccuccguaaaguuaagaccgugucacuaaacgaagccaucaaguccccgcacugcauagugcaaaaggacuuuaagaagaaacuacuuucgcuccuuaaacaaaacuucgaugcuaaagaggucaaggcuuacuucgaggaacacaaagacguaugguccgacaucaaccuaagcaaaaucgaaguauacuacuucacaaaagacacaaaggaaagauuuuucgcaacccguaaaccacucgauaguagcuucgaucgcaagaaaauagaaucagugacagacacaggcauccagaaaauccuccuaagacaccucgaacagaaaaacggagacuccgaccuagccuucucucccgacggcaucgaggagaugaaccaaaacaucguccaacuuaacgggggcagaaaacaccaaccgaucguaaaagugcgaguguacgagaaagcggauaaauucgcgaucggccagcagggcaauaaggcuucgaaguauguagaagcagcaaagggaaccaaccuauuuuucgcagucuacgaagaagaaguccgagacaaaaagacaaacgccgucauguucaaacgaaauuacgcguccauaccacucaacguggccaucgaucgacaaaagaaaggacucuccaccgcccccgaagacgaaaacggcaacgcccccauauuugugcucagcccaaacgaccuggucuaucucccaaccgcagaggacaucaucaacgcacguaucucuuucccgauaaacaaaaacagaaucuauaaaauggucuccugcacgggcuaucagugcuucuucauuaaacaccauguugcgaaugucaucgucgacaaaaaggaguucagcgcccucaacaaaauggagaaagcagagacgaacgaaaugaucaaagacaucugcguaccaaucaaacuggaccgacucgggaacaucguaaaaauaggcgucuacaaguga

SEQ ID NO: 6925 - RNA, 4587 nt, Artificial Sequence
  Cas9 variant
augaagaaaauccugggacuggaucucggcaccaauagcaucgggugggcagucgucaacagcuucgaugaaaaccagaacgaggagucgcuaaagcauauagagugcguaggcagcaggaucauaccgauggacgcagccauacuaggugacuuugauaaaggaaacagcauaagccagacagcgaagcgaaccgaauuucggagcguacgccaucugcgcgagcgacaccucuuacgccgcgcucgccuccacaaaauacuuagcuuacuaggcuuuuuacccgaccacuacguccaagaccucgacucacaugguaacuuucccguaaacgucgaaccgaagaucgcauggcgcaaggacuccaacggcgcauucgaauuuaucuucaacgacagcuuugacgaaaugcugcaagauuuugcaacauaccaaccagaacuaaucgcauguaacaagaaaguccccuacgacuggacaaucuacuaccuacgcaagaaagcccucaccaagaaacuaagcaaagaggaacucuccuggauccuacuuaacuucaaccaaaaacgcggcuacuaucaacugcgcggugaagaggaugacgaaagcgucaaaagcgccaaaacgcggcaauacuucgaccgucagaagaucaaguccaucguggacacuaaccaaacauacaaaggccaaaagguucucauagucgagcuugaagacgggaucaaaggaaagauauucaagaaagaaaucccgaauugggucggccaggaaaaaucaaucaucguaacaauagacauagauaaagacggcugcgacaaauacgaagaaagcggagaacuguccugcagauucaagauccccucggaugccgaaugggaauccgaauggaagcuaaucaagaugaaaacccaaaaggaucucgacgccucaggcaagaccgugggcgccuacauuuaugacgccauacuccagaacccaagccaaaagauucggggaaaacucguccgaaccaucgaacguaaauauuacaaagaggaacucaagcaaaucuuaaagaaacaaguagaguuccacccagaacucagggacaaagaccuguuucucgacugccucaacgaacuauaccccaacaacgaugcgcaccguaacgccugcgccgacagagacuucaucuaucucuucauggacgacauuuuauuuuaccaacgcccacuaaaaagcaaaaagagccucaucgcggauugcccauacgagaaacacauguaccgcgauaaggaaacuggcgaacucaaauacuccuccgucaagugcauagccaagagccacccacucuuccaggaguuccgacucuggcacuucauaaguaacauccgcauauaccaaaaagaacgagucgucgacgucgacgcgugccagccagaccucucaagugcccgaagcgcacucaaaaguaagcuagaagccgacgucgacguuaccaacgaauuuuuaacaugcgaagcagacuacguaagccuguucgagugguugaacaauaaaaagagugugagccaaaaggacuuccuaaaauacccagccuucggcaucaagaaaucaggcgacaacuaccguuggaacuacguggaagacaaauccuaucccugcaacgaaacccgcgcacugauccucagccaccuagaaaaagccaacauacgcggcgacaucuucacacgcgaacaagaggaagcacucuggcacauccuauacucuguagaagacagguaugaaaucguuaaagcccuccaaucguucgcggcaaaauaccgauucaacgacgacuucgucacuguauucagcaaguucccucccuucaagaaagaguacggcucguacuccgccaaagccaucaagaaacuccucccccucaugaggaugggaaaauacuggagcgaagcggccauagacaucaaaacgcgagaacgcauagagaaaaucaucacaggagaaugugacgacagcauaagggaacgcgucagacucaaagcaauaagacugcacgauaucggcgacuuccgcgcacucccagucuggcucgcaugcuaugucgucuacgaccgacacuccgaauccggagacaucacaaaauggaagacaccccaagaaauggacugguauauacagaacuucaagcaacacagccuucgaaaccccauaguagaacaggucauaaccgagacucugcggguagucagagacauauggaagcagguugggaggauagaugagauccacgucgagcucggccgggagaugaagaaccccgcagacaaacgcgcaaagaugacggcccgcaugauugaaaacgaaaacacuaaccugcgcauaaaagcaaugcucaccgaguuccuuaacccugaguucaagaucgaaaacguccgucccuacucggcgagucaacaggacauccuaagaaucuacgaaaacggcguguugaacucgguaagcgaaauacccgaagaaauuaccgggauacuaaagaaguucaaugaacgcgaacagcgaaagagaccuuccaccagcgaaguccuuagauacaaauuguggcucgaacagaaauaccggagccccuauacaggcaagaugaucccgcuagggaaacuguucacgccagccuacgaaauugaacacauaaucccccaguccagauauuucgacgacucguucaauaacaaagucauaugugaagccgaagucaacaaauuaaaagggaaucuacugggguacgaguucaucaagaaacaucauggacggcgcguagaccucggguugggggagaucgucgacauauucucgguggaugaguacgaaaccuuugugaaagacuacuacucugcaaaccagcagaaaaugaagaaacugcuaauggacgagauuccggagcaauuuaucgaaaggcaacugaacgacucccgauacauauccaaagucguuaaaagccugcucaguaacaucguccgggaacaagacgaacaggaaucaaucuccaaaaaccugaucgucugcacgggaggcguaacagaccgucuaaagaaagacuggggcaucaacgacguguggaacaaacucauacucccgcguuuccaacgucuuaacaacauaacggagaccaccgaguucaccgccaagaacaugcaaggacacgagauccccgucgucccuuucgaguaccaacgcggauucaauaagaaacgcauagaccaccgccaucacgccauggacgccaucguaaucgcgugcgccggacguaacauaguaaacuaccucaacaacgagucagcaagaaagaaagcccaaaucucccgauacgaccuacagcgcuugcucugcgauaaaguaaagaccgacgacaacggcaacuacaaguggauucuuaagaagcccuggucgacccuaacccaagacguguacgcagcucuagacaacgucauaguguccuuuaagcaaaaucuuagaguuauaaacaaaaccaacaaucacuacguacacuaugaggcaggcaagaaaaucauagcuaagcaagaaaaagccuccugggcaauccggaaaccgaugcacaaggacaccgucuucggcgaagucaaucuacgaaaaguaaagaccgugagccucaacgaagccaucaagucaccgcauugcauaguacaaaaagacuuuaaaaagaagcucuuaagccuccugaagcaaaacuucgaugcgaaggaagucaaagccuauuucgaggaacacaaagacguguggucggacauaaaccugucaaaaauugaggucuacuacuuuaccaaggacaccaaagaacgcuuuuucgcuacgaggaagccucuggauuccucuuucgacaggaagaaaauagaauccgucaccgacaccggaauacagaaaauccugcuucggcaccuagagcagaaaaacggcgacucggaccuugccuucagccccgacggaauagaggagaugaaccaaaacauaguccaacugaacggcggccgcaaacaucagccaauagugaagguccgugucuacgaaaaagcagacaaguuugccaucggccaacagggaaacaaagccuccaaguacgucgaggcggccaaaggaaccaacuuauucuuugccguuuacgaggaagaaguacgagauaagaagacaaacgcagucauguucaaacgcaacuacgccagcaucccacuaaacgucgccaucgaccgccaaaagaaaggcuuaucaaccgcccccgaggacgaaaacggcaacgcacccauauucguccucagccccaacgaccugguauaucuccccaccgccgaagauaucauuaacgcuaggaucuccuuucccaucaauaaaaacaggaucuacaaaauggucucgugcacggguuaccaaugcuucuucaucaaacaccacguagcaaacguuaucguggacaaaaaggaguucuccgcccuuaacaagauggaaaaggccgaaacaaacgaaaugauaaaagauaucugcguacccaucaaacuagaccgcuuggggaauaucgugaagauuggagucuacaaauga

SEQ ID NO: 6926 - RNA, 4590 nt, Artificial Sequence
  Cas9 variant
augaagaaaauccucggacuggaccuggguacaaauucgaucggcugggccgucgucaacagcuucgaugaaaaccaaaacgaggagucacucaaacauaucgaaugccuaggcagccgaauaaucccuauggacgccgccauccucggagacuuugacaaggggaacaguauuagccaaaccgccaaacggaccgaguuccgaggcguacgccacuugcgagagcgacaucuccugagacgcgcgcggcuccacaagauccucagacuauuaggguuccucccugaccacuacguccaggaccuagacggccacggcaacuuccuggucaacgucgagccaaaaauagccuggcgcaaagacucuaacggcacuuucgaguucaucuuuaacgacucauucgacgaaaugcuccaagacuucgccaccuaccagcccgaacucaucgccugcaaccgaaaagugcccuacgacuggaccaucuacuaccuaagaaagaaagcacucacuaagaaacucuccaaagaggagcuguccuggauccuccugaacuucaaccagaaacgcggguacuaccaacuccggggcgaagaagacgaugaauccguaaaaaccgcaaaaacacgccaguacuucgaucgacagaaaauaaaaucgauuguggacaccaaccaaacguacaaaggccaaaaaguccuaaucguggagcuugaagacggaguaaagggcaaaauauucaagaaagaaaucccaaacugggucgggcaagagaaaucgauaaucgucaccguagacauagauaaagacggaugcgacaaauacgaagaaagcggagaacuguccugccgauucaaaauacccucagacgccgaaugggagagcgaauggaaacuuaucaagaugaagacccagaaggaccuggacgccucaggcaaaacggucggagcuuacaucuacgacgccauccuccaaaacccgagucaaaagauacguggcaaauuaguacguacgauagaacgaaaauacuacaaagaagaacucaaacaaauacucaagaaacaagucgaguuccaccccgaacuuagagacaaggaccuauuccuagauugccuaaacgaacucuaucccaacaacgaugcgcacagaaacgccugcgccgaccgcgacuucauauaccuuuucauggacgacauccuguucuaccaacgcccccuaaaguccaagaaaagccuaauagcagacugccccuacgaaaagcacauguaccgggacaaagaaacaggcgaacucaaauacuccucaguaaaauguaucgccaaaucgcacccacucuuccaggaguuccgacucuggcacuucaucucaaauauacgaauauaccaaaaggaacgcguaaucgacguggaugcaugccagcccgaccugucaagcgcccgaucagcacucaaaagcaaacucgaagccgaugucgacguaacaaacgaguuccucacuugcgaagccgacuauguuagccuguucgaguggcugaacaacaaaaagagcgucagucagaaggacuuccuaaaauauccggccuucggaaucaagaaauccggggacaacuacagguggaacuacguagaagacaaaucauacccaugcaacgaaacacgcgcacuuauacucucccaucucgaaaaggcaaacauacggggcgauauuuucacccgcgagcaggaagaagcccuauggcacauacuauauagcguggaagaccgcuacgagauagugaaggcacuccagucuuucgcagcaaaguaucgauucaaugaugacuucguaaccguguucagcaaguucccgccguuuaaaaaggaguauggcagcuacagcgccaaagccaucaagaaacuucugccgcuuaugaggaugggcaaauacuggagcgagagcgccaucgauaucaaaaccagagaaagaaucgagaaaauaaucaccggggaaugugacgacucaauccgcgaacgcgugcggcucaaagcaauacgccuccacgacaucgaacacuuucgugcccuucccgucuggcuagcgugcuacguaguauacgaccggcacagcgagagcggcgacaucaugaaauggaaaacgccccaggagauggacagcuacauccagaacuuuaaacagcacucacucagaaacccgaucgucgaacaagucauuacagaaacccuuaggguaguccgcgacaucuggaaacaagucgggcggaucgacgaaauacacgucgaacuaggccgagaaaugaaaaaccccgccgacaaacgaaaagagaugaccaaaaggauaaucgaaaacgagaacacaaaucuacgaauaaaggccauguuaacagaauuucuaaacccggaguucgaaauagaaaacguccgaccuuacagcgcgucacaacaagacauacuacgcauuuacgaaaacggaguacuaaacuccgucucggaaauccccgaagaaaucaccggaauacuaaagaaguucaacgaacgagaacaacggaaacggccaagcacuucggaagugcuccgcuacaaacucuggcuggaacaaaaguauugcagccccuacacggggaaaaugaucccgcucggcaaacuguuuacgccugcauacgaaaucgagcacgugauaccccagucacgguacuucgacgauagcuucaacaacaagguaaucugcgaagccgagguaaacaagcugaagggaaacuuacucggguacgaguucauaaagaaacaccacggacaaaggguagaccucggccuaggcgaaauaguggacauauucagugucgacgaauacgaaacauucguaaaagacuacuacagcggcaaccagcagaaaaugaagaaacugcuaauggaugaaauaccagaacaauucaucgaaagacagcuaaacgauucucgcuacauaagcaaagucgugaaaucguugcucucaaacaucguccgagaacaagaugaacaggaaucaaucagcaaaaacgugaucgucugcacagggggagugacagaccggcucaaaaaggacuggggaauuaacgacguauggaacaaacucauccuaccacgauuccaacgacuuaacaacaucaccgagacaaccgaguucacugccaaaaauauggaaggacacgagaucccagucguacccuucgaguaucagcggggcuucaacaagaaacggauugaccaccggcaccacgcaauggacgcuauagugaucgccugcgccaguagaaacaucguaaacuaccuaaacaacgaaucugcucgaaagaaagcgcgcaucucucgcuacgaccuucaaaaacucuuaugcgacaaaguccgcacagacgacaacggcaacuacaaauggauacuaaagaaaccauggggaacucuaacccaagacgucuacgcggcacuagauaacguaaucguaucauucaaacagaaccugcgagucaucaacaaaacaaagaacuacuacguccacuacgaggcaggcaagaaaaccaucgcgaagcaggaaaagggcagcuccugggcaaucaggaaaccaaugcacaaagacacuguuuucggugaagugaaccuacggaaaguaaaaacagucucgcucaaugaagcaaucaaaaacccccaaugcauaguagaaaaagacuucaagaaaaagcugcucucccuacucaaacaaaauuucgacgcaaagaaaguuaaggcguacuucgaagaacacaaagacgugugguccgacauaaaccucagcaaaaucgagguauacuacuucacaaaggacacgaaagagagauuuuucgcaacacgcaaaccucuagacagcuccuuugauaagaaagaaauugaaagcguuaccgacacagggauucagaaaauacugcuaagacaccucgaacaaaagaauggagauccggaccucgcguucucccccgacggcaucgaagaaaugaaccacaacaucguccaacuaaauggugggcgaaagcaccaaccaaucguaaaagugcgcguauacgaaaaggccgauaaguucgccauuggccaacagggaaacaaaagcagcaaauacgucgaagcugccaagggaacuaaccuguucuucgcgguuuaugaagaagaaguacgagacaagaaaacaaaugcagugaugcucaagcgacauuacgcgucaaucccgcucaacgucgccaucgaccggcaaaagaaaggccucagcacugcgccagaagaugaaaacgguaacguacccaucuucguacuauccccaaacgaccucguauaucuccccacugccgaagacauagccaacgccuccaucucguuccccaucaacaaaaacaggauauauaaaauggucagcuguaccggcaacagaugcuucuucauaaagcaccacgucgccaacgucaucguagacaaguccgaguucucaguucugaacaaaaucgaaaaagcugaaaccgacgagaugauaaaggaaaucugcguccccaucaaaauagacagacugggcaacauaguuaaaaucggggucuacaaauga

SEQ ID NO: 6927 - RNA, 4608 nt, Artificial Sequence
  Cas9 variant
augaacaccauccucggccucgaccuuggaacaaacaguauuggaugggcucuaauuaagguucuaaacgacaagacacgacucccacuagaaaucauagaccugggaguagucgucaucccgaccgaccaacguacccuagacaaauucuccaaaggagaaucgaucucgaagacugccgaacgcacaaagcaaaagggaguacgaaaacucuacgaaagaaagaaacuucgacgcgagcgacuccacagaguccuaaacauccuaggcuuccugccggaacacuauagcaaaaagaucgacuucaagaaacaucucgggcaauucuucggcaauucccagcccaagaucagcuacgucgaaaacgaucacgggaagcacgaguucaucuucauggacuccuaccgagaaaugcucaaagaguucucuaagcacaauauaaagaacgugcccuaugauuggacuauauacuaccuccgcaaaaaggcccugagccaaaagaucagcaaggaagaacuagcaugggucauucugaacuucaacaagaaaagagguuacuaccaguuccgcgacgauaacgcagacgagaacaaagaaaauaaaaucgaaaaguacuacgcacuaaaagugaccaacgucaaaaaggaagacgcccaaaacuacacaaucacucuugaaaacggauggaucuacaaaaauaaguccaagauaagccuucucgacugggucggcagcacgaaagaguucaucaguaccgaaaaguuugacaacaaaggcaacauuaucaagaagaaaaacggcgaagacgaccgaacacucaaacuuguugacagugaaaaggacuggaucgcaaucaaaaagagcacggaagaccggauagagaacuacggaaaaaccgucggcaccuaucuguacgagcauuugcuuaaagaccccaaccagaagcuaaacggcgagcuuauaaacaucaucgaccggaaauucuacaagaacgagcuaaaacagauccuugagaaacaaaaggaguuccaccccgaacuccugaacgaagaucuauuccagaaaagcauaauagaacucuacccuaaaaacuccacccgccaaaaggagcuuaaaaacaaggaccuaugcuaccucuugauagacgacgucaucuauuaccaacgcgaccuaaagaagaaaaacucaacgaucaacaaaugcuccuucgagucccgcgaguacuacuuaaacggagaaaaacagauccagaaaauaaacugcauugcaaaaucgaaaccacucuaccaggaauuucguacacuccaguucauaaagaaccuaaaaguguacgagauuaucgacggacuagaaaaagacauaacuucgaaacuucuucccgacuucgagacaaaagagcacuucuucgaguggcuaaacgacaaagagaaaauagaccaacuacagcuccuguccuacaagugcuuugaccuacacgacaacgucaagaacgaucugauagccaaaggcaucaagcggcccaccgaaaaggccauccgcacggagcuacucgaaaaauaccgcuggaauuacagcaaggauaaugaccgcaacuuccuacucaacgaaacccgcuuuaaaauccuaaaguaccuuaagaaaguagacaagaaacuaacccucacgaacgaacagaucgaaucccucuggcuccuacucuauagcgcaaaagacgaaagagaacuuaaaaauggccugcaaaaauucuccgaaaagaacaaacucccaaagaaguucucggauaucuucaucuccuucccgcccuuuaaaaaggaguacggcgcuuacagcgaaaaggcccucaagaaacuccugagcuugguccgauucggaaaauacuggucguucaacaaaauagacaacaacauacagaacaagauaaugaacauucucaacggagaaguagacgacagcauauccgaccgcgugcgggaaaagacaauccugcuucaagacaaaaacgacuuccaagaucuaccccucuggcuagccuccuacgucgcauacaaccgauucagcgaaguaagcgagauaaaauacugggacucacccgacaaaauugaguucuuaaaacaacacuccauaggcaacccgaucgucgagaaaauaaucaacgaaacacucaagcucaucaaagacaucugggugauucauggaaaaucgugcaaaaacuucuucucggaaauacacaucgagcucucgcgcgaaauaaagucaucguccaagaaacgagcgcaaaucaccaacaacaauacgaaaaaccagaagcuaaauaaccucaucaagucccuccucauagaaauggccuccgacaccaaauacgagaaugucaccccauacucgccgucacaacaagagauacucaagaucuacgacgagggcaucuacuccaaggaggagaacagcgaaaagauaaaagaaauaaacaagauccguaauaacaauaaaauaucgaagucagacauaacaaaauacaaacuuuggcucgaacaaggcuacaucucccccuacacgggaaagaucauaccgcucaccaagcuguuuacugccaaauaccaaaaagagcacaucaucccucaaaccaaauucuucgaugacucguucaauaauaaaguaauaugcgaagcagaggugaacaaacucaaagacaauagccuagcuaugaacuucaucaaagccaaaggcgggaaagccguaaaacucuccgacggagaaacagucacgauccucaaccaagaagaguauaagcaacucguccgcacaucauucaagaaaaauagcauaaaacuacggaaccuucuccuggaagaaauacccgacacguucacaaaacgucagcuuaaugacacgaaauacauuagcaagcuagugcucucccuccucagcaacauaguccgagaaaaaggcgagcuggaaucgaccgccaaacgcaucgucuccacaaacggacaaaucaccuccauccugcgcaaugacuggggucugaacaacauauggaacaaacuaaucacacccagguuugagcgacucaauaacaucaacaaaaacaagaucuacggcaacugggaaaacaagaaagguaaaaacguauuucagauuaacuaccucaacgauaaccuauccacccuaaacacaaaaaggaucgaccaccgccaccacgcacuggaugcgcuaauaguggccugcaccacccgaaaccauauaaacuuccucaauaaccaauacgccaaaagucgcaaccaacgccacgaccuccgggccaagcucaaacgacgagaaacaaucacgacagaagguuccaagaaacaagucuuuaaagacuucauaaaaccaugggagagcuucacgcaagacgcacuaaagaaacuagagaccaccaucgugaacuucaaggucaacaaacgcaucauaaauaagaccaucaacugguacaagaaaugggaaaaacaaaaagacggcaccuauaagaaaauccaaaagaaacaaaccaaaggggaugcgugggcuauccgaaaaccgcugcauaucgauaccaucuauggaauaguaugcaagaaacuuccgcucaaaagcgcccuggaaaacuacaaaaacaucaucgaugaaaaccuuaaacacaaaaucaaagagcucaaagagguuaacaaauucgacaacaaccagaucauuaacuucuuuaaggaaugcaauuucaucuucgaggauaacaacauccaaaaaguagagguguacgacuucaaggacaaccgagacaaaacaauacucuccagcucgcgccagcugauagaugagagcuuuacucccaaaaagauagguaagguacucgacccaaccauucgaaacauacuacugaagcaccugaacagcacgaaauauaacaacaaguucgacuccgauggcaauccaauuaaaccagaaaaacuagcuuucucgcccgaaggccuaaaagaccuaaacaaaaacauaaaacaccucaacaacaauaaagaacaccaaccgaucaaacgcguuaaacuguucgagacgcucggaaauaaaaucaaagucggcuacacacagcagaagaacaagaaauucgccgagaccgcgacaggaaccaaucucuuccucgguauauacuccgauaacaacaaacgcgacuucaagacaaucccgcucauccuggcaauccagcgugaaaaggagggacugaauccgugucccgacaccgacgagaagggcaaccaacucuuauucucacuaucccccaaugagcuggucuucguacccaacaacgaggaacgaaagaaccccaaccucguagauuucgaaaaccuauccaaagaccaaaucgaccgaauuuacaaauuugucagcuguacuggcagcgaggccuacuucguccccucacggacagcgaagccaauaauugagaacgaaaacggcacuaacaacaagagccaaaggaucaucgaauuuaaugagaaaaccuccauuaagaacgagaaaaacgaaccagugcuaaucaagacuauauguuggaaaaucgaaguuaaccgacuaggcaaaaucaucaaagucauuaaauga

SEQ ID NO: 6928 - RNA, 4608 nt, Artificial Sequence
  Cas9 variant
augacgaaaauacucggacuugaccugggcacgaacagcauagggugggccauucgggacacggaaaacgaaggaauaaaucagauacucgacaaaggagcccggauauuuuccgaaggcgugaaauccgaaaacgguaaagaaauaagccgagcagcggaacggacggcauaccgaagcgcucguaaaauaaaauaccgcagaaaauuacgcaaauacgaaacacucaaaguccucaguauaaacggcaugugcccacucagcguagaagaaguugaacaguggaagaaaagcggauucaaagaauacccacucaaccccgaauuucucgacuggcugaggaccaacgaagacaaaaacauaaauccauaccuguucagagacaaggccagcaaacaaaaaguaacacuguucgaacugggcagggcccuguaccacaucgcccagagacggggauuccucagcaaccgguuagaccaaagcgcagaaggcgucuucgaagaacacaacccccaaauacaaaaccucaucgaagaccuagauagcuccaacacaauacuaaacgaauugaaagaauacuauauaaaccuaggcauaaucgacgaaaccgagaaaagcggguucaagaaagaccuggacgaaggcgagaagaaacuaaaaagccuauacaacucacugguugcgauaacaaagaaaaacgccaacgacauagaaacaugcaaacaagaacugaucgcacgccucaacaagaaagaagaccucggcaaaguaaagggaaaaauaaaagacauaucccaggccauguuggaccguaacuucaaaacacugggacaauacuucuucuccuuauacaacaaggaaaggauaagaaaccaguacacaucgcgagaagaacacuaccuggaagaauuuauaaucauaugccagacgcagggaauagagggcauaaacacgaacgaaaaacuacccgagaagaaauucaccggccuagcaaaagauuuauaccgggccaucuucuuccaaaggccucugaagagucagaaaggccucaucggcaagugcuccuucgagaaaaacaagucacgaugcgccgucagccaccccgacuacgaagaguucagaauguggucguaucuaaacaccauaaaaauagguacacagagugagaaaacacuccgguuccucacccucgaagagaagcuaaaacucgucccaaaauucuaccggaaaagcgacuucaauuucgaaguccucgccaaagagcucgucgagaaaggggcaaguuucggguacuacaaaagcaguaagaaaaaugaguucuucuacugguucaacuacaaaccgacggacagcgugagugcaugcguagucagcgcuucacuggaaaaugcaaucgggaaggacuggaaaauaaagacauucgaauaccaaacccgaaacacagagaaaaacgaggucacaaaaagcgucgacuauaaagaucucuggcaccuguuguccguggccacauccgacaccuaccucuacgacuucgcaaucgagaaacugaagcucgagcccaaaaacgcgaaagccuucucgaaaacgaagcugaagaaagacuucgccucucuuagccuagcggcaauagccaaaauccucccauaccucaaacagggacuccucuacagccacgcaguauucauggcuaacauagaaaacauaguagacgccgacaucuggaaggaugaggaacagcaaaaguucauccagaguaagauaguggagcucguggauaacuacaucgucgaaaaauccaaacuagaacugaucaacggacugcucaaaauauacaacaccgaagacaaggaaggccggaagguauacuacagcaaagaagccgagagcuuauucgaggccgaccuccgcaagaagcuagugcccuucuacaaggcaaacaucaucauagaggaacacgaacaagaaaucauauuccaagaccuguucccaauacugauggaccaacucaagaaacaggaguucaucaaaaucggacgccucgacaagcaaaucgaagcauuccucgagggcgagaacgaagaaggccagauauuuugcaaccauaccgacaaauugaagaaacuauaccaccccagcgacaucgaagucuuuaaaaagaaaacgauaaaagaugaauggggaaacgaaaaggucguacucggcucuccccucaccaccuccaucaaaaacccaauggcgaugcgagcccuacaccagcuacggaagguacuaaacacacucaucgccaaugaccaaaucgacgaagacacgcggauccacauagaaauggcgcgggaacugaacgacgcgaauaaacgaaaggggauacaagacuuccaaaacgagaacaagaaauuccgagaggaggccauaaaggagauaaagaaacuguaccuugaagaaugccacaaagacguaaacccaacagaggacgacauccuacgcuaccaacucuggcuggaacaggguaaaugcgagauauacgaagaaggaaacaacauuucgauaugcgauaucaucggcagcaaucccagcuacgacauugaacacaccaucccacgcagcauaagucaagauaacucgcaaaugaacaaaacacucugcagccucaaauucaacaggucgaucaaaaagcagaagaugccaguugaauuguccaacuacaacgauauacugcccagaaucgcgcauuggaagaaagaggcugaagaacucacccggcagauagaaacaaucagcaggucgaucaaaagcgccgcaacaaagguggcgaaagacaagaauauaaggaaacggcacuaccuaacgcugaagagagacuauauccugggaaaauacgagagguucacgugggaggaaccaaaagugggcuucaaaaacagccagaucccugacaccgggaucauaaccaaauaugcgcaggccuaccuaaagagcuacuucaagagaguagagagcguaaaaggaggugcaguagccgaguuccggaaacuuuggggaauccaagagagcuucauagacgaaaacugguggaagcacuacaaagacaaagaucgcgacaagcacacucaccacaccaucgacgcaaucaccauagcaugcaugccaaaggacaaauacgaccuacuagcgcaugcguggcggcucgaagacgaacaggacaagaaagcggcaaaaguccuaaucgaacaggcaaaaccauggaagaccuucaaggaggacaucgaaaagauagagaccgagauccuugucucacacuuuacaccggacaacgucaaaaagcaaagcaagagcauaauaaagaacaggggaaagaaggucuacgucuugaaaaacgagcuuccggugaauuucaaaaacaaaaucgaaggcaaagacuacuucaagcugaaguucgacagcaaaauucucuacaaaauuccuaaaaagaaagaaaagcaaaccgacacauucuaugaggaacucccaaagaacuaccuaaacggagucgagggaaaggacuacuuuaaaaucaacacuacgggcaagacuuucuacaaaaucccgaucuuuaaccaaggagacacuauaagggggagccuacaccaggaaaccacguacggcgcgauuaagcucccggacauagacaucgaaacaaagaaaccacugcacaccgacaaaggaggcuucauccugaagaaagauaucaaggguaacgagaucguauucuuugugguccggaaagaaaucagcaaaaucagcgaaaacgaugugcaaaacauaguagacaacguaguacggaagaaaauagagaacgcaauagcaaacucccuaaucaccuucaaaaucgucaagaaaaagaaagucgccguaauaaaagaaggagucacuauauggaugcgggagccaaacauagagaaaggaauagagggaauacccaucaaaaaggucagaaucaucacgaacagcgucaaaaaccccaucgaaauaaagguacacuccccacuaucaaaauccagacacaagcacaaacaaaaaguuuauggacaaaacgacgagaacuacgcaauggcccuauaugaacucgacggaaaacgggaguucgaacucauaaauaacuucaaccucgcaaagcuccuaaagcaaucccaguccuauuacccacuacacaaagaaaaagagauuaagggaaagaaaauccuagugccuaucgagaaacggaauaauaaagauguaauccugaagcgcggacaacagguggucuucuacgacaagacagucgagaacccuaaggacaucagcgaaaucauugacuucagggagcgcauuuacauaaucgagggacucaccauccagcgacaaaaggacaagaaaacauccaaggugaacgaauacggcaucauacagcuaaggcacuucaaagaggcgcggaaaagcgaagaaauauccaaggacaacuucaaacccgacggugaguucaagauaaacgagaacaagcccacccgcaagaugaaucauaaccaauuuaccgccuucguagaaggcauagauuucaaagugcuacccuccgggaaauuucagaagaucuga

SEQ ID NO: 6929 - RNA, 4614 nt, Artificial Sequence
  Cas9 variant
augaaaaagauccuaggauuagaccucggaacaaauucgauaggcugggcacugacuacaaaugacuucgacacgaagaaaggaaccaucgagggccugggaagcaggaucauacccaugucccaagacauccuaggcaaauucgacagcggcguuucacucagccaaaccgcccagaggaccgaguaccggggcaagcgucgccuaguccaacgauuccugcuacgaagggaacgacuccacagaguguugcacauuuuagaacuccuacccaagcaguacucagaggccaucgacuucgacaaaaagcucggccaguucaagccagagcgcgaacagaaaaucagcuucuauaaaaacgaguccgggaaaaaccaauucaucuucaccaagucgcaucaagagaugcucaccgaauuucaaaccuacuaccccaccaucaaaaacaucccguacgacuggacaauauacuaccuccgcaagaaggcgcucacggagaaaaucagcaaagaagaacucgcauggauacuacucaacuucaaccaaaagcgcggguacuaccaacugcgaggagaagaaaaagaagaaaacaaaaacaagaaagaagaguuucacacgcuccuagucacggacaucauagagagagacaaaggaaaauccgggaccugguacaauguaauucucgaaaacggcuggauauacaaacgcgagucaaaaauuagccuagcagacuggauaggcaaaacgaaauccuucaucgugaccacggaguacaacgacgacggcucagugaagcucaccaaagacaaugaggaaaagaggucauuccguucccccaaagaagacgacuggggccugaucaaaauccggacagaaaagacaaucaaccaauccgacaaaagcgucggggccuacaucuacgacgcccuacucaaaaacccuaaccagaagauaaaaggcgaacuggugcgcacaaucgaacgcaaauacuacaaagacgaacuacgcgaaaucuuaaagaaacaacucgaguuccacagcgacguacuuaaugacaaaauccucuauaagaaaugcaucgacgaacuguacaaaaacaacgacucgcacaaaaacucaauaaaagaccgcggguucgacuaccucuuucucgacgacaucauauucuaccagcgcccccugaaguccaagacuucccucaucucggacugcagccucgaguuccggccaaucaaaaacaaaaacggcguccuugucaaagacaccgacggcaaacaaauagcaaaagcacuaaaaugcaucgcacggucaaauccgaucuuccaagaguucagacuccugcaguucgucaaaaaccucaaaaucuacaagcgaggaguagucgacgacgucgaggucacuaacgacuaccucaagucagagaacgacgucgagaaacuauuuaauuggcuaaacgauaaagcggaaauaaaucagaagcaguuucuggucaacuucaagcugaaggaggacaaacaccguuggaacuucguagaagacaagggcuauccauguaacgaaacccgcaaccaauuccugaacgcuaucgccaaaaucgacgucgacaaguccuuuuucaacacgaaaaacacacaagaccuauggcacauacuauacucugucacggacaagauugaaauaaccaaagccaucaccaccuucgcgaagagacacaaucuaccuaaugaauuuauaauaaacuucaguaaaaucaagcccuacaagaaagaauacggcucauucuccgagaaagcgaucaagaagcugcuaccccucaugcgcuucgggucguauugggacgcuaaaaauaucgacauaaagacacuagaucgaauugacaaaauacagaccggcgaguucgacgagaaaaucaggaaccgagucagagaaaaagccauagacuuacacaaaaucgacgauuucaaagaccucccgcuuuggcuugccucauacauugucuacgacaagcacucggaggccucggacguaagcaaauggaaaaccccagcggacauagaaaaauuccuaaagcacgaguucaagcagcauagccuccgaaaccccaucguagaacaagucauaacugaaacccuccgagucgugaaggauaucuggcugcaauacggcgaagggaaagaaaacuucuucaacgaaauccacaucgagcucgggcgcgaaaugaagaacgacaaagccacccgcgaaaagaucagcaagaaagucuccgaaaacgagaauacaaaccuacggauaaaagcuauccuaaccgaacucaaaaaugauggcgugucugauauaaggccguacuccccuucccagcaagagauccuaaaaaucuacgaggaagguguauacaacaacgaaagccgaaaagaaaaacuagaagaggucgacaaaauacggaaaaacgcgaagcccaccaccagcgagauuaucaaauauaagcucuggcucgaacaaggcuacgcauccccguauacggggaagcugauuccgaugagcgaacuauucaccacgaaauaccagauagaacacauuaucccucagucgagauucuucgacgacagcuuaucaaacaaggucaucugcgaauccgaaguaaacgagcucaagagcaacaugacggcgcuugaguucauccuaacaaacgaaaaccguaucguaacucuaacgggcggagagacugucaagauauucacaaaagaagccuauaaccaacacaucauaucauacuauagcaagaacaaaaacaaacaaaaacgacuucugacagaggaaaucccugaacaauucauaucacgacaacuaaacgacacuaaauauaucagcaagaucgugaaaaaccuccuguccaaaaucguacgagaagaggacgagcaggaaguaacuucgaaacacguagucagccucaacgguuccauaaccagccgaaugaaacaagacuggggccuaaacgauguauggaacacgaucgucucaccgcgcuucgaacgucucaacacgcuaaccaacucgaacgacuucgggcaauuugagcucaagaaggacgcuuauggaaacgaggggaaacgcgucuuccaaacgacggucccugacgccauagcgaaaggauucaccaagaaacgaauagaucaccggcaccacgcccuggacgcccuaguaaucgccugcguaaaccgaacacacauaaacuaccugaacaaucuaaacgcaaaagacacggacgacaaagcagugaaacacgaacugcgcaacaaauuaugcuucaagaccaagccagacucaaacggaaacuacaaaugggaauuucacaagccgugggaaaaauucacuaaggaggcgcaagacaaacuaaacacaacgauagucaguuucaagcagaacacuagagugauuaacaagacugugaacaaauacguaagcuauaaagacgaaaacggaaaccuuaacguggaugcaaacggacuaccccagaagaaagugauaacccaaacaaagggggacaacugggcaauccgaaaaccucuccaugcagaaacggucuccggcaaggucuuccucaaacggauaaagcagucacacaucaccaucgcuaaugcgaucgaacaaguggaauugauagucgacaaggaagucaagaaacaacuaaaagccaagauuaagcucuacccgaacaacauagccggccuaaagaaacacuuaaaagcguuuccugucaugauaaacgacaaagccaucgauaagauccaaauauaugagacgcucgaggccaccgccacgcggaaaauacuagacauuacauuugaugaaaagaaaauacagaaaauaacggacacaggaauacagaaaauacuccuuaaccaccuaaagcaagagaaauaccaaaacaccgucgacgaaaacggaaagaaacuggcgccccacgagauagcuuucucggaaaacggccucgaagaucugaacaaaaacaucaccuuccugaacgacgggaaaaaccaccaaccaaucaaaaaggugcggauauuugaggaaggaaacaaauucccgcugggggaagugggcaacaaaauaaacaaauucguagagaccgccaaaggcacaaaccuauucuucgcuguauaugaaaaugacgacaagaaacgaaacuacaaaaccauaccauucaaugaggucauagagcgccaaaaacaaggacugaaugcagcccuugaaauagacgaaaacgggaaccgccuccuauucacacuaucccccaacgaccucguauacaucccgcucgaggaugagauugguuaccucaacggaguguacuuuaaaaaccucaacaaagagcagaccgucaggaucuacaaguucgucaguugcaccggcggagaaggacacuucguuccgaacaacuacagcaaagaaauuaucucaaacgagaacgggaguaacaauaaaaacgaacggaugcucaacuucaacaacuucaacaucauauucgauggaaaagaaaaaccggucaugauaaagagcaucugcuggaagcucgaagucgaccgguuaggaaaaguaauaaaaaucauaaaauga

SEQ ID NO: 6930 - RNA, 4617 nt, Artificial Sequence
  Cas9 variant
augaaacacauucuuggccuggaccuaggaaccaacucgaucgggugggcgcucguaaaaagcgaacaagacugcgacgacguugagaggauuaacggaauagaagccgccggcagccguaucauucccauggaugccgcuguucugggagauuuugcaaaaggaaacaccaagagccagacggcugaccggacugccgccagagggauacgacgaaugggagaacggcacaagcuccgccgggaacgccugaaccggguauuggacguaaugggauuccuucccgaacacuacagcgccgcgcucacccgcuacgggaaguucaaggacggcgaagaaugcaagauagcauggcgcaaagacgagagcgggcaauggaccuucguauucgaggacuccuuccgggaaaugcucgccgacuucgucgcccaccagcccgaauggcuggccgggggcaggaaggugccuuacgacuggacaauuuacuaucugcggaagaaagcacuaucaaagccucugacaaagcaagaacuagccuggcuacuacuaaacuuuaaccagaaaaggggauacuaccaacugcgaggcgaagacgaacauacagacgacaaaggcaagcuaguagaauacuacgcacucaaaguuguuggagucgaggauacaggcgacaagaagggcaaagacacgugguucaacauaaugcuagaaaacggcauggucuaccguagaccugcagccgaagcaccggacuggaucggcaaaacgaaagaguucauaguaacgacggaccuagagaaggacggaaccccaaagaaagacaaggagggcaacauuaagcgaucguucagaaugcccaaagaagacgacuggacccucaucaaaaagaaaaccgaaaacgacaucgauagguccgggaaaacuguaggcgaguacaucuacgacgcacuccuagcagacccgacccagaaaauccgagggaaacuggugcgcacggucgaacggaaguacuacaaagaggaacuaaagaaaaucauuaacagccagaaaagauucauacccgagcuaaacgauaacgaacuauacggccgaugcauaagugaacuauaccaaagcaaugacgccuacagacaaagcaucuccagcugcgacuuuaccuaccuuuucguagacaauaucauauucuaucaacgcccgcugaaaagcaagaaaucacuaaucgacaacugcccauacgaggagcacagcuauacagacucgaaaaccggcgagguaaaaacggcacccguaaaaugcgucgcaaaaagcaacccacuuuuccaagaguuccgccuguggcaauucguacaaaacauccgcauauuugaacgccagaaaaagaucggggauucagucaagacugacgucgaugucacgggcgaguucauaaagucggccgaugacguggucucccuauucgacuuccugaacgacagaaaggacaucacccaaagcguccuacucggaacauacuuuaagaucaagaaaccaaaagggaaagacucagacuacccauaucgguggaacuacguggaagacaaaacguaccccugcaacgaaacacgugcgcuaauauugaagggucugaaagacgccggcaucgacgagggcuuucucgacaaggacaaagaguacagccucuggcauauacuauauucgguugaagacaaacaagagaucaccaaggccauggaaaaguucgccgcuaaaaacagucuuggcgggaaauucgcagaaguuuucagcagcuuaccuccauucaauaaaaacuacgggucguacuccgaaaaggcgaucaagaaauuacuggcucucaugcgaacgggaaaauacuggucggcagacgcuauagacaaacacacccuggaacguauagacaaaauaauaaauggcgaguacgacgaaagcauacguaccagaguccgggaaaaagcaauuaacuugacagacgugucccacuuuagagggcuaccccuauggcucgcauguuacauagucuacgaccggcacagugaaagcaaagacauaaccuguuggaacugucccgcggacauagaccaauacuuagaccacuucaaacaacacagccuccgaaauccuaucgucgagcaagucgugacugaaacacugcgaacaguccgggacaucuggcgacaauacgggaagaucgacgagauacacaucgagaugggacgcgacaugaagaaccccgccgacgugagagccaaaaugucaaaaagaaugaucgacaacgaaaacgccaaccugaggaucaaagcuauguuggccgaguucgcagacccagacuuugggaucgcaggcguccgaccauacaguccaucacaacaagaaaugcuuagaaucuacgaggagggcgcccucgaauccguagacgaaguacccgacgagauaaacgagauaaucucaaaauucaaccaaacagacaucaagaaaaggccaacccacggagaaaucauaaaauacaaacucuggcucgagcaaaaauaccagagcccauacacuggaaggacgauaucccuuagccgccucuucacggacgacuaccagaucgagcaugugauaccccaaaguagauacuucgaugacaguauguccaacaaagugauaugcgaagcggaaguaaaccagcucaaagaucgaaugcugggcuacgaguucauaaaggcgcaccacggggaaaaaguauugcuaucuaguggcgaaacgguaacgauccuuacagcggaagaauacgaacgccucguacaguugaauuuucgcaaaaaccccguaaaaaugaaaaagcugcuuauggacgacauccccgacaaguucauagaacggcagcucaaugacagcagguacauaagcaagaaaaucaaaucacugcuaucuaacaugguccgcgacgaaggggaacaagaagacaucuccaagaacguaauagcgugcaacggagcaaucacagaccgacuuaagcgggacuggggaguuaacgaugucuggaaccacaucauacuuccgagauucgaacgucugaacgcggucacgggcucggaccgguucaccacaaccaguaccaacgggcacacgauccccgacaugccucuaaaccugcagaagggcuucaacaagaaacgcauagaccaccgccaccacgcaauggacgccaucgucaucgcaugcacaacuagaagccacgugaaccugcucaacaaugaggcggcaaugagcaagaacaacgcagugcgauaccaacuaagccguaaacuccgcagauacgaggauaccauggucacgagaaacggagagacgaggacgauaucggucgcccgggaguuuuuaaagccuuggccgaccuucaacgcagacgucgagaaagcccugagaggcaucgugguuagcuuuaaacaaaaccucagaguaauaaacaaaacgguaaacaaguaccaaaaguucgucuacaacgaagaaaaacacauuaaggagaaaaaggcaguaaggcaggaggaacgaaacggaaggcaccuacucgccaucagaaaacccaugcacaaggauacaguauacggugaagucaaccucaggcgaaucaaagaaguaucgcucaaggacgcagucgccaaccccaaagccgucguggacaaagaccucaagaagaaacuuauggccaugaucgaacuaggguaugaccugaaacaaauaaccaaauauuucgaagacaacaaggacgccuggcaggaugucaacuuaaagaaaaucaaagucuacuacuucacuaaagacaccggugaccgguauuucgccacgcgguucggaaacgaccuggucacccucuucuccaagauaacgaaagccgacgaugcgaaaaagcaaauagaacgaauaacagacacaggaauacagaaaauacucaagagacaccucgaggcgaacgggggcgacugccaaaaagcauucucggcggacggcaucgacgaaaugaaccgaaacaucacgcaacuaaacggagggagaccacacaaaccaguauacaagguaagaauauacgaaaaggccgacaaguuugcgauagggaccaaaggaaacaaagcggcaaaauucgucgaggccgccaagggcaccaaccucuucuuugcaguguaucuaaaagaguacgaagauagcacaaccggcgagacaaucaagaaacgcguauuugauacaaucccacucaagaccguaauugaucgccucaagaacgggcagacccccgcccccgaagaaaaagacggcgccaaacucuuguucgugcucagcccaaacgaccuagucuaccucccaaccgaagacguaguaaagaacggcaccaucaacagaccccucgacaagcgcaggauauacaaaaugguaucaugcacaggcacggagugcuacuacaucccauucaucgucgcaagcccaaucguggacaaaguagaguucuucagccuaaacaaaauaggaagggcaauuacaggcgaaaugauaaaggaaaucugcauaccaauaaaggucgaccgccuaggaaacauaacggaagucaacaaugaaaagaucuga

SEQ ID NO: 6931 - RNA, 4623 nt, Artificial Sequence
  Cas9 variant
augaacaagauccuuggccuagaccuuggcacgaacuccaucgguugggcccucguugggaccgacgaagaagggaacccaauccggauauacaagaguggcagccgaaucaucccaaugucgcaagacguacucggaaacuuugaccgaggaaacagcauaucgcaaacagcugaaagaacauccuacaggggcgugcgccgacuacgagaacggcaccuacuccgacgagagcgccuccacagagugcugcaccuuaugggcuuccuacccucacacuacgaagaagcaauagggugggacaaaggggacaacaaaacguucgcaaaauucuacuccgacaccgaacccaaacucccguggagaaagaacgcagaacgagaacacgaguuccuauucaacaccccauauaacgaaaugcuggucgacuuccguaaaaaccagccacaacucuuuaaaauuaagaaaaacggccaagagucccuaauccccuacgacuggacgauuuacuaccuacgaaagaaagcgcucagcaaacccaucuccaaaaaggaacucgcauggauaauacuuaacuucaaccagaaaagaggcuacuaccaacuaagaggagaagaagaagaagagaauagcaacaagcugauagaguaccaugcccuaacgguaguaaagguaaucgcggacgaaccccaaaaagggaagucggacaucugguacaaugcugaacuggaaaauggauggguauauagacgcuccuccaaaaccccacuauucgacugggaaucgaaggugaaggaguucgucgugaccacugaccugaacgcugacggaucccugaaaguggacaaagaagggggcguaaagagaucguuccgcgugccgagcgaggacgacuggaugcuagucaagaagaagacggaaucagacauagaaaagagugacaaaaccguaggaugcuauauauacgauaccauacuacaaaacccaucccagaaaauccgcggaaaacucguacggacaaucgagcgaaaauucuauaagaaagaacuuaccgaaauacuaaacaagcaaaaggaguuccacagcgaacuacaaaacaaagaacuauaccaagaaugcauaaaagaacucuacccccacaacgaagcgcacuacgacucacuacucguaaaagacuacacagaccucuucguuaacgacauaauauucuaccagagaccccucaaaucgaagaaaucccucaucagcaauugcccuuaugaauaccggguguaccgcaacgacagcggaauaguagagcgcguaccuaucaagugcauagccaaaucccacccgcuauaccaggaguucagauuauggcaauucauccacaaccuccgaaucuaugagcgccaacgugaagugaacggcaaaccagaaacggacgucgacauaacggccgaguucaucccaacaaccgaagacaggguaaaacucuucgacuggcuaaacaacaagaaggaaauaaagcaagacacgcugcugcaaagcuacuucaagauaaagaagaagaaaggcgacgacaaauucccuuaccgauggaacuacgucgaagauaaagaauacccgugcaacgagacgcgcgcgcucauauuaagucgacugaccaaacugaaccuaucagaagacuuucuuacgaaagaaauggaacuggcacucuggcacauacuauacagcguggaagacaaagaagagaucaagaaagcauucaaaucguucgcccaaaaacacaaucuagacgacucauucguagaccaguucaucaaauucccgcccuucaagaaagacuacgggucauacagcgcgaaagcaaucaagaaacugcugccacuuaugcgcauugggaaauacugggacgaaaaagccaucuccgggaacacgcgaagucgcauacucagcauuaacgaacgacuagaggacaugcgcucguccggaaagaaaaucgaggacgucagcgacgacgacauccccaaacaggugcucaaauccuucgacaaaguaaacggaguauacucaggccucaacacuuaccaagcgugcuacgcggucuacgggcgccauagcgaggccucugaaaucacuaaauggaaaacgccccaagacauugacgauuaccucaacgaauuuaaacaacacucacugcgaaacccuaucgucgagcaagugaucacggaaacacucagagugguacgagacauauggaaaaaguacggcgacuuuagcgagauccauauugagcuaggcagggagaugaaaaacccagcagauaaacgagcaaagaugaccacgcagauaagugaaaacgaaaacacgaaccuuaggaugaagagucuccuggccgagcucaaaaaccacaacgaugucgaaaauguucggccuuacuccccuagccaacaggaaauccucaaaaucuaugaggagggaguacugaacuccgucucggaaaucccagaggagaucauaaaaaucaccaaauccagucagccaagccaaacggagcuugugcgcuacaaacucuggcuagaacagaaauaccgcucaccguacacuggcgaaauaauuccgcugggcaaacucuucaccuccgcauacgaaauagaacacgugaucccgcagagccgcuacuucgacgacagccucagcaacaaagugauuugcgaaagugagguaaauaaacuaaagggcaaccuacugggguacgaguucgugaaaaaccaccacggcgucaaagucgaacucaacuucaacaaaacaguugaaaucuuuuccaucaacgaauacgaagaguuuguaaaaggcaacuacggcaagaaucgcggaaaaaugaagaagcugcuccuagaggauauccccaagagcuucauagaacgacaauuaaaugacacccguuacaucuccaaggucguuaaagggcuccuaucaaacauaguaagggaagacggcgagcaagaggcaaccucaaaacacgucaucccaugcacaggcggagucacaacaauccuaaaacaagacuggggccucaacgaugucuggaacaaaaucguaaccccgcgauucgagaggaugaacgagcuaaccaacacaagccuauucggccaaugggaaaacaaagaggggaaaagaauauuccgcacggaggugccacucgagcuacaaaaagguuuuaacaagaaacgcauagaccaccgacaccaugccauggaugcaaucguaauugcgugcgcuacacgaucccacguaacguaccuaaacaacgaaagcucaaaggcuaaugcaaaagagauucgugauggccucaaacauaaauugugcuucaaaagcaaaaccgacgagacgggcaauuacaaguggcaguuccauaagccgugggacacauucacccaggacguccaagauacacucgagaacauagucaucuccuucaagcaaaaccuccgcgucaucaacaaaaccaccaaccgcuaccaaaaguacgaagaagaaaagaaaauacuaaaaucgcaagaaaaaggugacucgugggccauaagaaaaccucuacacaaagauacagucuuugcaaaagucucccuacagaaaauaaaaugcguaaaacucgcgauggcacucaaggacuggaaaaacaucgucgacaaacaacugaagaaagaaauccgccgucuaauccucuccuacgggaaauucgacgcagaaauccucaacaaauacuucaaagacaggaaguacauauuuaaagacguugacauuagcaaagucgacguguacuacuuugagaccgaauacguagcaacccgaaagaaucucgacaccucguucgaccggaaaagcaucgaguccaucacggauacaggaauacagaaaauacuccugaaccaccuaggcgucaaaaacaacaacccagaacucgccuucucagcagaggggauagaugaaaugaaccaacggaucguggagcugaauggcggcaaacaacaccaacccaucuacaaagucagaauguacgaaccacuaggaaauaaguuccagguaggcagaaucggaaauaaaaaggacaaauauguggaagccgcacccggcacgaaccucuucuacgcgauuuaccaauccgaggauaaaaagcgaauauacgacaccauaccccuaaacaucaucaucgagcgccaaaagaaagaacucuuccccguacccgaaaacaaagaagacaaagacaaccucuacaaguugcuauucuggcuguccccgaacgacaugguauaccugcccacggagaaggaaugggccaaccccgaccucuucaacuuuaauaacaugaccaagaaucagcgcaagaaacucuauaaauucaucgauggcucagguacgaccgcgaacuucaucccuaacaccgucgccaacauuaucuucucuauacccaagaaagacucagggaaauacucaauggguaaccgcauaguacaaaacgaguucggcaucggaagcccccaauccaagaaucagaaagccuucaccggcgagaugaucaaggagcggugcuggaaguugaagaucaaccggcucggggacaucaucgaaugcauaaaauga

SEQ ID NO: 6932 - RNA, 4629 nt, Artificial Sequence
  Cas9 variant
auggaaaagcgcauacucgggcuagaucuaggcaccaacagcaucggaugggcccuaguaaagggggaaaggcacgagaacgacaacgaaacuauccugagcuacauagaagccgcuggcucacgcauccugccacucgacgccgcagcacagggagacuucgaaaaaggcaaccccgcgaagacccaaaccucugaaaggacacgcaugcggggcaugagacaccuccuagagaggagccuacuucgaagagagaggcugcaccgcguacucgacauaauggacuuccugcccccucacuacagccagagccugacccgcuacggcaaauucaaggcagacacagagugcaaacuagcauggagaaaaaccgagacagggcacuacgaauuucuauuccaggauagcuuucaagaaaugcugcaagacuuccaaaaucauggaaaacuagaggaaaauaaaaagaucccguacgacuggacaauauacuaccuucguaagaaagcccugacgcagccuguaagcaaacaggaacuagcguggauuuuacuaaacuucaaucagaaacgagguuacuaucaacgugaagaccaagccguggacgacaaccaaaaaaagcggguagaguaccaggcccugaaaguuaucuccguggaggacaccggagaaaaaaaaggcaaaaacacuugguacgacguacgacucgagaacggucuuguauaccauuacagcgcaccaauaaagccagacuggaaaggcgaaaccaaagaauucaucguaaccaccacuauugaccaaaacggcaaacccgaacuggacaaagacggcaaacccaaguacucaaugagggcacccaaagaagaugacuacaaacuauuaauggaaaaaacgaaaaaggacaucaccgauagcggcaaaucagugggugaauacaucuacgacgcauuacuagucaacccccaacaaaagauccguggaggccuuguacgcacgauagagagguacuucuacaaaaaagaacuggagaagauccuacugagccaagagcgauuuauaccggaauugaccgaccgcgaacuguaucgcaggugcguagaggagcucuaccccagcaacgacgccuaccgccacuugauagagucacgcgacaugcgguaccuccucguggaagacaucuuguucuaccaacggccauugaaaagcaaaaagagcuugaucgacgacugccccuaugaaucacgaucguacgucgaccgggagacaggagaaaucaagagcucgccagucaagugcauagcgcagucacacccucucuuccaagaguucagacuguggcaauucauacauaaccuccgcaucuaccagaacgagcgcagcguugaaggaaagcuacagcucgacguggacgucaccgaagaaguguuacccaccccagaaagcaaagcagcacucuuucgguuucuuaacgaccgggaaaaugucacacaggaaaucuuacugaaagagguauucaaagggcgaaaauuaagcguaaaagacugcccauaucguuggaacuacgccggagaaggaaaaaaguacccaugcaacgagaccagacaucuuaugcucaaacuccugaaaaaagcaggaaucgacacugcauuccucaccccagagaaagaacaggcccuguggcacaucauguacagcguagaagacaaggaucaauacgaaaaagcacuuucaacguucgcacgaaaaaacgaucugcccgacggcuucaaagaacaauucaaaaaagcaccaaccuucaaaaaggauuacggagccuauuccuugcgagcaaucaaaaagcuguugccucucaugcgcgugggagaauauuggucagcggacugcaucgacagcgaaacgaaagaacggaucagucaaaucauccggggagaaauggacgaaaagguaucacaaagaaugacaaagucaagagacucuuuuacggacaucucccaauuccaaggccucccaguauggcaggccuguuaugugguguacggccgccacagcgaggcaacggaaauccagaggugggagaaaccggaggacauagacguauaucuaaaggcguucaaacaacacucgcugcggaaccccaucguagagcaggugguacuagaaacccuucgggucguacgcgacauauggaagaccuauggaaagguagacgaaauacacauagagaugggacgggacaugaagaacaccgcagaagaaagaaaacgcauauuuaaccgcaaccagcaaaaugagaacgacaaccugcgcauaaaagcgcuccucacagaguucaugaacccagauuuugagauagagggagucaggccauacagcccgagccaacaagaggcacuccgcauuuacgaggacggcgcaugguccggcuuagacgaagagaaagaagacaaaaaagagcucgaagcaauucgcgagauccugggcaaauucagucaaucggacaaagccaaaagaccgacgcacagcgaaguccuaagauauaaagcuuggcuggaacaaagguauagcaguccauacacaggggaagccauaccacuggccaagcucuucacgccagcguacgaaaucgaacacguuauaccccaaucccgguucuuugacgacagcuucagcaauaaaguagucugcgaagccgaggucaauaaacugaaagacagaaugcucggcuacgaauucauaaaggcgcaccaaggugaaguagugucgcuaucaggaacaggccggugcgcacgcauccuaagcccggaagaguacgagcagcgaguaaccgacugcuacaaacacaacaccgcaaagaugaagaagcuacuuauggaggagauaccagacgacuuuauccaaagacaaaugaacgacagucgguacaucuccaaacugguaaaaucacugcucucgaacauggucagggaagaaggagagcgagaggccaucucaaaacacguaaucacaugcaacggaacgaucacggaccgacuaaaaaaagacuggggggugaacgacguuuggaaucacaucauacucccccguuuucagagaaugaaagaccucacuggaagaaacgacuucguugcagucaauucacaaggacaugagauccccuccgucccaccggaacuacaaaagggauucaaaaaaaaacgcauagaccaccgacaccacgcgauggacgcaaucgucaucgcuuguacaaccagaaaccacguaaaccuacuaaacaacgaagcugccaugucggaaaacaaagccaauaggauagcccucucgcgcaagcuaagacgcuacgaaaacugcgcgaucuacaagggcggcgagacaaagaacauaucaguggcaaaagaauuccuuaaacccugggcgaccuuccccgcagaugucgagcgggcccucggcgacauaguagucagcuucaagcaaaaccugcggguaauaaacaaggccaccaaccacuacgagcauuacaaggacggcaaaaaaguuaaaguuccacagaaaaaaggggacaugugggucguacgaaagccccugcacaaagacacgguguaugcacucguaaaucugcgcaacguaaagaccguuggccugaaggacgccauacuaaugccagaucgaauagcgaauaaagaccucaagaaaaaaguaaaggaacuccuggcccaaggcgaugaccuaaaaaagaucaaaaaauauuucgagacggagaaagacacauggcaggacgucgacgucaagaagaucgaagucuacuauuuuucagaagaaacagcaaaccacuacuacgcaacgcgcaaaccauuugacgccaacgugaagaucgauucagugacagacaccggaauacaaaagauauugaggagacacuuggaagagaacgguaacaaagcagacguagcauucucgcccgaaggaaucgcacgaaugaacgagaacaucuuucgguuaaacggaaacaaacaccaccaacccauauauaagguacgaguauaugagaaggccaauaaauacccgguaggccagacaggcaacaaagcaaguaaauuugucgaagcggccaaaggaacaaaucuauaccucgccgucuacgaaucagaaguagucgacaaaaaaaccgcagaaaucaguaaaaagcgcagcuacguaaucguaccucuccgagacgccguagcgagacaaaagcaagggguccccgucgcgcccgaaagaaacgaggagggaggcaagcuacuguucgugcuaagccccaaagacuuugucuacgugccaacugaagaggaacggagcaaaggcgaagugcugcucccacuagacaaaaacaggaucuacauaaugauggacgcaucggauggaauaguaaacuuccuccccuacagcgucgccaacuugaucuacgcgcucccaaaagaccaagcuuccggguucugcaccgacggcaggaugauccagaacgaauucggacuagggucuccuaaaagcaaaaacgaacgagcacuaacaggcgagaugaucaaggaaaucugccuucccguuaaagucgaucgacucggccgcaucacagagaucaacggaaacaaagucuga

SEQ ID NO: 6933 - RNA, 4644 nt, Artificial Sequence
  Cas9 variant
augaagaagauacucggccuagaccugggaaccaacuccauaggcugggcuuugacgaacaacgauuucgacaacaaauuagggucuauagaaggccuuggcucgcgaaucauccccaugagccaggacguccugggcaaauucgacucgggagucuccaucucgcaaacagcagaacggacgaaauaucggggcacacggcgacucguccaacgauuccucuuacggcgcgagcgucuccacagaauacucaacauacucgacuuccucccacgacacuacucggaagcgauagacuucgauaagaaauucgggcaguuuaagcccgaacgugaagaaaaacuuucauucuacaaaaacgaauccggcaaaaaccaguucuuguuccuagaaucgcaccaagagauguucuccgaguucaagcucacacaccccgaccuaaaacaaguaccauacgacuggacgaucuauuaucuccgcaagaaagcccucacccagaaaaucaguaaagaagaacuagccuggaucauccuaaacuucaaucaaaaacgaggauacuaccaacuccgaggcgaagaagaggaaguaaacaaaaacaaacuagaagaguuccacacccucguaaucguagacgucaucgaacgugaaaaaggcaaaucaggagucugguacaacguaauucuggaaaacggcuggaucuacaaacgagagucaaagauagcccuguuugacuggaucggaaaacaaaagaacuuuaucguaaccacggaacucaaugacgacggaaccaucaagcucaacaaagacaacgaggagaaacgaucauucagaucaccgaaagaggacgacuggggccuacggaaaauccgaacagaacaaaccauaaaccaauccgaaaaauccgucggcagcuucaucuacgacgagcugcuaaagaaaccaaaccagaagauaaaaggagaacuggugcggaccaucgagcgaaaguucuacaaggacgaacuaucgaagaucuuaaaagcccaaaucacauuccacuacgaaauccuuggagaucgaaacauauacaagaagugcaucgacgaacuauaccgccacaacgacucccacaaaaacaauauuaaagauaagggauucgacuaccuguuccuugaugacaucaucuucuaccaacgaccacucaaguccaagacgucucuaauaagcgacugcucacucgaguucgugccgauuaaagacaaaaaggggauccuggugaaagauagcaaugguaaacaaguggucaaacccuugaaauguauagcgaaaucaaaucccaucuuccaggaauuuaggcuacuccaauucguuaaaaaccucaaaauauacaaaaaggaaaucauaaacgagaucgacgugaccaacgacuaccuuaaaacagaagaggaucugguugaacucuucgacuggcuuaacgacaaagcagaaaucucccaaaagcaguuccucgcauacccuaaauucaaacucaaagaagacaaguaccgauggaacuucgucgaggacaagauuuacccaugcaacgaaacacguaaccaauuccucaacgccauugcaaagaucgaugucaacaagucguucuuugacgcgaaaaacacccaggaccuguggcauauccuauacucagugaccgacaagacggaacuauucuccauaaacacugaaacgggcauacaauccggcgcacucucaaccuucgcaaaacgccauaaccuauccaacgaguucgucucuaacuucucuaagauaaaacccuacaacaaagacuacggguccuacuccgaaaaggcgaucaaaaagcuacugccgcuaaugagauucgguagcaacuggaauaaaaacaacaucgaugcuaaaacccuagcacgaaucgacaagcuacaaaccggagaguucgacgaaacaaugcguacccggguacgcgaaaaagcgauccaccugaguaaaaucaccgacuuucaagggcugccgcuauggcuugccuccuacaucaucuacgaucgacacucggaggcuucuaacaucucuaaauggaagacaccagaagacaucgcuugguuucucaacccgaaaaauaaaucuggcuucaaacaacacagccucaggaauccaauuguggaacagguaaucaccgagacccuccgcguaguuaaagacaucuggcagcacuacggcgaaggaaaggaaaacuucuucaacgagauccacauugaacuuggccgggagaugaaaaauaacgcgaacgaccggaagcggauuacggagacaauaaaccagaacgagaacacaaaccuacggaucaaagcaauacuaacggaauuaaagaacgacggcaucaacgacguccgcccauacagccccucccaacaggaaauacucaagauuuacgaggaagguguuuacaacagcgaaaucagaaaggaaaaacucgaagauauagauaagauaagaaagaacgccaaacccacgccaagcgaaauaaucaaauacaaacuguggcuagaacaaggcuauaucuccccauacacaggcaagcugauaccccugagugaucuguucacaaccaaguaucagaucgaacacauaaucccgcaaucccgauuauucgaugacucacuauccaacaagguuaucugcgagucggaaguaaacgacuugaaggggaacaacaccgcccuggaguucauacucaagaaugaagggagaaucguccuccugacagggggcaaaaccgucaagaucuuuacaaaggaggccuacaaccaacauauaacguccuacuacaucaaaaacaaaaguaagcagaaaagacuacuaacagaagagauacccgaaaaauuuauagaccgccaacucaaugacacaaaguacaucucgaaaauagugaaaaaucuacucaguaaaauaguacgggaggaagacgaacaagaaguaacaucgaaacacaucguaucgcugaacggcagcauaaccucacgcaugaaacaagauuggggucuaaacgaugucuggaacaaaaucgugaguccccgcuucgagaggcuaaacgcgaucacaaacagcaacgauuucggcaaacucgaacuaaagaaagacgaguucggaaacgcaggcaaacaagucuuccaaaccacagugccugacgacauugcgaaaggguucuccaagaaacggaucgaccaccgccaccacgcacuagaugcgcucguaauagcaugcauaaacagaacgcacaucaauuaccucaauaacuuaaacgccaaagacgaaaacgauaagaccaucaagcacgaacuccgaaacaaacuuugcuucaagacuaaaccagacagcaacgguaacagcaagugggaguuccacaaaccgugggaaaacuucacgaaaaagguagaagacgaguugaaccaaaccaucauaucguucaaacaaaacacacgugucauaaacaaaacggucaacaaguaccaggucuggaaagaggaagacggcgccaugaagaaagugaccgugaaacagacgaaaggcgacaacugggcaauccgcaaacccauccacgcggagaccgucucgggcaaagucuuccugaaacgcaucaaacagucccacauuaccauagcaaacgcgaucgagcaaauagagcucauaguggacaaagaaguacggaaacaacucaaagccaagaucaaacaguacccaaacaacaaagaaggguucaagaaacaucucaaagcguucccgauaaugaucaauggcaaagccaucgacaaaguccagauauacgaaacgauagaggcaaccgccacgcgcgagcggaauaaccuagacaucaccuucgacgaaaagaaaauagagaagauaacagacacaggcauccagaaaauacucuugaaccaucugaagcaggagauauaccaaaaugccaucgaugaauccggaaagaaaauagcgccacacgagguagcguucucggaaaucgggaucgacgagcucaacaaaaacauaaaaguccucaacaaugguaaaaaccaccaacccauaaagaaaguacguaucuucgaagaaagcaaacgauucucacucggccaauccggaucgaagaccgacaaauacgucgagacggcgaaaggcacaaaccuauucuacgccauauacgaaggcaaaaagggcaauagaaacuacaaaacgauaccccucaaugaagucaucgagcgacaaaagcaggggcucaauuccgcgcuggucacagacgaaaacgaaaaccggcuccuuuucacgcucucccccaacgaccucguauacauuccaacaaacgaagaaaagaaaaaccucaccaccauaaauuucgacaaacuuucacgcgagcaaaccgaacgcauauacaaauucgugagcuguaccuccggagagggacacuucgucagcaacaauuauucgaaagaaaucauaucaaacgaaaacggauccaacaacaaaaacgaacgcaugcucgaguucaauaauagcaacaccaucuacgacgaaaaggagaaaccaguaaugauaaaauccgucugcuggaaguuagaggucgaccgccucggcaaaauaaaacgaauaaucagguga

SEQ ID NO: 6934 - RNA, 4677 nt, Artificial Sequence
  Cas9 variant
augaagaagauccuagggcucgaccuaggcaccaauucaauuggaugggcacucgucaacguggauaagaacggcaacccauucggaaucgaaggccugggaucccgaaucauacccauggaccaggccacgcuaagcgacuucgagaagggcaauucaaaaagccagaccgcggaacgcacgauguuccgcggcgcacgacggcugcgcgaaaggaagcaccuccgcagagaacgccuacaccggauccuuaacgaacucaacuuucuacccauucauuaccgguccugcauugacuucguacacagauuagggaaguucaaagcgaaccacgaaccaaaaauagccuggcgcaguaacgaccaagacaaaauggaguucauauuccaaaacuccuuccuggaaaugaugagcgacuucaccaagcgccagccggaauuaguaaaggaaggcaaaaagaucccauacgauuggacaaucuacuucuuaaggaagaaagcgcugggccagcgcauagagaaagaggaacuagcauggcuccugcuccacuucaaucaaaaacgaggcuacuaccagcuccgcggcgaagaugaaauagacgcaacacgaucagccaagacgcgcaaguacuuugaccgcaaaauuaucaagucaaucaucgauacaggcgaggaauacaagggccuaaaaguacuaaucgucgagcucgauaauggcaaccaagguaaaaucuuuaaacaagaagucccagacuggguaggacaggagaaaaacaucauagcuaccguagaccuugacaaagacgggaaagaucgguuugacaaagguguacuaagucaacgauucagcaucccuagcgacuccgaaugggaaacagaauggaaacugaucaaacuaaagacagaggaagaccuagaggcaagccagaaaaccgugggcacuuacauauacgacagccuccucaaaaacccaaaccaaaagaucaagggaaagcugguacggacaaucgaacgcaaguacuacagagacgaacuucgggcaauacucaacaaacaacgcgaguuccacccagaacucaacgacaaaaaguuauaccagcacugcauuuucucccucuacccacaaaacgaagccuuccgaaauuccauagcaaacaaagacuucacuuaucuauuccuugaagacaucaucuucuaucagagaccccuaaaaucgaagaaauccaccaucaacaacugcgccuacgaaguccgacgcuacauggacaaagaaacaaaagaacugaaagaggucccccugaaaugcaucgcaaaaagccacccgaucuuccaagaguuccgccuguggcaguucaucuccaaccuccggauuuauaagaaggacauuacggacauagacgugacaaacgauuuccuccacucccaagaugauuacgccaaccucuucgaauggcugaacaacaagaacgaaauagaucagaaggccuuucugaaguaccccgccuucggauucaagaaggacgcugucaacuaccgauggaacuacguugaagacaagucuuaccccugcaacaagacaaggucagccauccugucuaagcucgacaaacacgaacaagaauuucuaacgaaagagcuagagcuaaaaaucuggcaguuauuauacagcguaaacucgaaagaagaaaucgacaaagcccuuaacgugaacuccccgaaaaucaauaauaaaaucucaaucgaccacacuggcauucuccaugaacucaaaucauccucccucagcgacauauccauccaaagacucaaagcaaucaacuucgaggaaaaagacuacgggagcuacaguuauaaagccaucaagaagcugcucgcccugaugcggcagggcaaguacuucgacaacacggcaauuaccgacgccaccaaagcacgcaucaacucuauauucgaccguuuggaguccaucucauucgacccugaacgcauaaacuccaucagcgaugacgacauuccgaaacagauccucaaaucauucaucaagcugaaccgaaccuacggcggguucaacacuuaccaggcuugcuacgcagucuacggucggcacuccgaagcgaaggaaauagcgaaaugggaaaaacccgaggacauagaccaauaccucgccaaguucaaacaacacucccuacgaaaccccaucguugaacaaauaauuacagaaacacucagagucguacgcgacaucuggaagaaacacgccuacaaaaccauaaacaaagacaaccaagggaacaacugcgaguccgaauccgagcucaccgaaauacacaucgaguuagguagagacaugaagaacaacaaaagcgaacgucuccgaauuagucgcaucaauucagaaaacgaaaacaccaaccuccggauacggaaacuucuuaucgaguucaaugacccggaguucgggguugaaaauguacggccccacucccccucacagcaggaaaucuugcgcaucuacgaagacgggguccuaaaaucaggcguagaaauccccgaauacguugauaacaucauaaagaaauucaaagaaacggacgucaagaagcagccgaguaaaucagaaguccuacgcuacaaacucuggcuggagcagaaauaucgcucaccguacacaaacgaaguaauuccccuaggaaaacuguucacgaacgacuaccagaucgagcacauaaucccccagucucgauacuucgaugacucuuucuccaacaaggugaucugcgaggcggaagugaaccaguuaaaggagaacgaacuugguugcgaauuuaucaugaacaacgguggcagaauaguagaacuuucauucggcaaaacaguccguauucucgacuucgaggcguacgagcaguucguacagcaaaacuacgcgggaaaccgacccaaacuccgaaaccucuugaugaccgaaaucccgaacgacuucaucgaucgacaacuuaacgacucgagguacauaucgaaggucgucaaaggccuccucuccaacauagucagagaagacggcgaggcagaaucgaccucaaagaaccucaucagcugcacaggcggcgucacagcucgcuugaagauggacuggggccuaaacgacgucuggaacaaucucauauauccucgauucgagaggcucaacgaacugacgaacaguaaccaauuuggauacugggacaagaaagacgggaaaaacgucuuccaaacgcaaguaccaauggacauacaaaaaggcuuuaacaagaaacguaucgaccaucgacaccacgcccuagaugcacucguaaucgcuugcgcaacccggagccacaucaacuaccucaacaacgaauccgccaaaucuaauuccaaagaaagccgcuacgacuugcgcagaaagcucagacgacuagaagugauccagaaagaauacacaauaaacggccguaaagaaauccguaacaucgaagucgcuaaagaguucuacaagcccuggaacucauucacccaggacgcccaauccgcacucgaaaauaucguggucagcuucaaacagaaccuaagaguaauaaacaaaaccacgaacuacuuccuccgcuuuaacaaagaaggcaaaaagauauucgaaacccaaaccagcggaucuaauugggcgauccggaaaccccugcacaaggacaccgcauuuggacuggugaaccucaagcgaaccaaaacagugucccuagcgaacgcaauccuggacuacgaccaaauagucaaucgaaaacuauggacuaaaauaaaagaguuaaucucgaucggauaugacaacaaacgcauccuaaaauacuucacagaugacaaagagaacuggaacgaaaucauauccucgggcaucgaggucuuuuacuacaccgacaacuucgaaaagcaggucgcgacacgaaagccacuggacaccucguucaccgaaagcaaaaucaucaacuccaucaccgauuuaggcauucauaaaauacugcucgcccaucuccgagccaacgaaggaaacccgaacaucgccuucucacccgaggggauagaaacaaugaaccgccacauaugugagcucaacggaggcaaauuccaccaccccauauauaaaguccgcgugcacgagccccuaggauauaaauucaaagugggagauaagggcaaccgcagcacgaaauauguggaggcggcgaaaggaaccaaccucuucuucggaaucuacaucaacagucaggguaucagaaguuacgagacgaucccccucaacguggcgaucgaacgacagaaacaagggcucucgcccguaccggauaacaaugagcucggcgagcgcuuacucuucuggcucagcccaaacgacuuaguauaccugccaacgagcgacgaagucgaauccggaaucugcugcaacaaauuagggauagaucgcauauauaagauggucuccugcacgggauacgucggggacuucauacccgcgcacauugccaacccaaucauucagaccuuagaacuggggagcaacaacaaagcucaacgggccuggacgggggaaaugauuaaagagauaugcauacccgugaagguagaccggaugggaaacaucgucgaaaucuucaaccgaaacaaaaacuga

SEQ ID NO: 6935 - RNA, 4695 nt, Artificial Sequence
  Cas9 variant
auggccaagauacucggacucgaucugggaacaaacuccauaggcugggccaucguagacgacaagaacaguaaaauccucgacacgggcguccgcauauuccccgaaggcgucgucgccaaaacgaucggcucaggagacaaagaggagucgaagaaugcaaaacgccgcgaaucacgccaaacccgaaggggauucuaccgaaagcgacuuagaaaaauaaaguuacuccggacacucauuaacuucaagaugugcccacucgaacacuucgagcuggacgucuggucaaaaugggacaagauuaaaaagaaagaaggccgcauggcaccagagcucuuucuaccggaaaacagcgcguacaaccucuggcucaagcaaaacccauacauccugcgcgacaaagcacucaguaaggacuuaacgcugacggaguucggccggguccucuaccaucucauccaacgacgcggcuucuuaucgaaccgaaaagggaaggacgacggcaaaaucuacggaggaaaagaaggcauagucggaauagacaaaacgaaugaacaaauaaagaacucaacacucgggaaauuucucuucaaaauacuccccaaggaaggcgaacccuucaaaaucaucgaagacgaguuaggaaaugagcuccgcguccgcucacgcuacacccuucgagacauguacauagcggaguucgaagcgaucuggaaccgccaggccaagcaucugggccuagacaauaucuacuacagcaacgugaagaauguacuccucaaaggaucgcugaaaaacaagaaaaaugaaaggaaaauaaaucaucuaaagaaaaucaaagggaacggcaacaucgaaauuaucacccugaauaauaacuuaagcaaaaacgaaaagcccaaauaucuccuaaaaaucgcaacgaagcucccacuaaaggaguuccuugccgggcgaaucgaaaaagacgaagacggcaaaauaaaguucaaaucuaaugaauccgugcucuuuuggcaacgaccccucaggagccagaagaaacuccucgccaaaugucgauuugaaccugaucugaaggacgacaacggaaaauucauacagaaaggcaaaacacccugccaccuuucccauccucuauacgaagaauaccgcgcguaccaauacgucaauaacauagaguacggcaagaagcaacgauuagaggagucgcagagaaaacaagucaucgaucucaucaacuccaaagauggcaacuucaaauucagcgaaauaaagaagaaacuaaaacuaagcuacgagacuuucaacuacagugacgacucgucggucaacggaaacuauaugaucaaaaaucuaaacaguauauucccaaaagagauacuugaaaaagaguucguggucaacguaaacaaagaagacaucaucgaauaugguuacgaacggauauggcaccucuuccacuucugcgaagacaacgacguacugaucaagaaacuacaagacaacuucgaccuaucagagaaugacauagagaaaaucucuaagauuaaccuuaaggaaggcuacuccaacgucucauugaaggcgauaaagaacauccucccauaccucaaagaaggaaaacuucuaagcgacgcaguaauacuagggggaguacgaaacgucuucgguaagaaguggcacgaguucauagauuuccacgaaaagauagaaaaggacauacuguacaucaaccaccagaagucaaacaaagaaggcgaggcuauagagaaaauuaaaaaguaccugauagacuacaaauuuggcuuuacggaaaacgacaaccgauucaaaaagcuguaccaccacucucaagacguaguagaagucaagcugcaaaagaaaaucgggcccguggaggaccuccgcaacccgaucguucagcaggggguaaacgaggugcgaagacuuguuaacgagcuccucgacguacacggaaaauucgaccaaguacgcguagaacuaggaagggaccugaaaaacaauaaaagcaaacgcgaagagaucgguuacaaaauacgcgagaauacagcaaagaacgagaaagcuaaagagcuacucaucgaguacggacugcgccagagucgagacaacgugcaaaaaguucuacucuuccaagaaaugcucgaccggggaacggucgccgugugcccauacacgaacaaaaccauaaacaucagcgacguccuaggcaacgagaacaaaaugcagaucgagcacauaauaccgaaaucaaucagucucgacgacagcuucgcaaacaaaacccugugugacucaaaguucaacgggcugaaaggcgagcgcacccccuacgaguucuaccaaaucaacaacgacgcaaacuuguggggcgguuccaaaagcugggaagaaaucgaacggcggacauuccgcauccucccauacaguaaagccaaacgcuucaccucgaagaccaaguuugagacgaaugacuucauccagaggcagcucaaugacaccagauacauauccaagaaaacgaaagagauccugucgcagauaugugaggacguacgugucaugccuggaucacucaccgcagaacucagaaaacuguggggacuaaacaacauccuccacccggccuucguccuagaccuccccgcccuacacaucgacgccaacaagcacaucccccacuacguaguacucgacgaggacaacguucccauccugucgcaacggaucuacaacgauaaaccgauauuaaaggccaaccagacaucaauaaccggauucguagacaacgaaauauucaagagcaaagaaaaauacguaaaauucgaggugaaagcacccaaccucucgaacggcgaauauugggccaagcuacuccucuccaacccgaaaucgaucguccgcgucuucaaggaaaaaccgaagucuacggaaaacgaaauagucguacgaggcaaaauagagaaagaaaaguucaaacacgaaggccucucaggcauuaacgccgagggcaaagaaaacgggacuuacugggccaagcuaagcauaguggacaagaaauucaagaaacccaagaaagacgaccagccaaagaaaaauggcaaacagauacuccuauuuggagccgugaaagagggcgucuuuagcagcuacauguaugaaugugacgccgaucucgaagauggcaaauacugguuaauccuggacaucgauuucgaaaauguggaguucgaaaaagcccuaaacgaacggccagaaguccuagaaaaccaaauccuuauccaaggaaucacaaacgacgaaaacgucuucgugagcgacauggacugucagcaccaauuccugaugaacgagggcaagggaaaauacuacguccuauucgacaucaucucagagguaaacgaguucuacccaaucaagacaaaaucgcccgaguuggaaaacggucagucccuaaccgaagggaccauuuggguggauaaguacacgggagagauaaaguucgacccaaagaaaaacagagaagaccaccgacaucacgcaauugacgcacucguaaucgcgcuaaccaaagaaaccuauuuucaacaacuaagcaggaggaaugcauccucagaaaacaagaaaagagguaacgaauacgaaaaagagcagcuugacuucgcugagccauggaaagaguuccacguagacgcccaaaaaucaaucaacagcauacucaucucucacaaacagaacaaaaacauauugacaaaaaucacaaagaaaauaaccaaaaacggcaaaaccuacaagucagaagggaugagcguacgcggucaguuacacgacaaaaccuacuacgggcacaacaagaacugcaaagcggacgaauaugucuaccgggucgacaucaauaaccucucauuuucgcaacugacaaacaucaucgacuuaaaccugaaggccguaauaguagaaggcguaaucaagaaauucgaagaguccgagaaacuccuguucaagaaaaugaacuccaaaguacaaaaccuagauaaaagcaaagucaagaaaaucaaagccaaagucgacaaaauacucaaggaaacguccuucuucaugcccaacgaggguaaacgcuacauccgccuaaacaucauagaacccgccaacuuugaacgcaugccugugccuaucaagaaaguccggauaaggaaagugcuccgcaacgcggagaaacugaacaacgaaauuaaacaauuuguagacccccagaacaaccaccacguccucaucuacaaagacgagaacggaaaccugaaggaggaggucguaaccuuuuggaccgugguagagcggaagcgcaccggcgaacccgucuacaagcugccauccgacgggaagaagauaguaaccaccuuacagauaaacgacauguuccuccuuggauugaacgaagacgaaaucaacugggagaacccuaacuacaaccaccucaaagaacaccucuaccgcgugcagaaguucacuuccggugacuuuuacuuucgcaucgccaaaaccucaucaauccaaaauggcgaagaaaagcaacaaaucaacucguucggccugggcaagaacggcuggcucacccacaacccuauaaaggucaaaaucucggucucagggaaaauucucaaaguauga

SEQ ID NO: 6936 - RNA, 4713 nt, Artificial Sequence
  Cas9 variant
auggaaaacagcaacaauuccucaaagaaguacuaccucggccucgacauggggacagauagcugcggauggugcgucaccgacgauaaauacaacaucauccgaucgcacaagaaaauauacggcccagauggcaaacugguaaagcgcgaggguugccaucuauggggcagucgccuguuucgacccgccaacaccgcaaaaagccgccgucuuaacaggacggcacgacgccgacuggcgcgacgccgacgacggauuauccuccugcgggagcuauuucaaccagagauugacaagguggauccaaacuucuuccgacgacucgaucaaagcaaccuguggaaugaggacaaagacaaggaacuacaaauggaacacaacuuccuauucaacgacaaagaccugacagacaaagaauacuacaaggacuuucccaccaucuaccaccuacgcaaagcuauggucaacgggcucaccauuaacggcuacuacuacgaucccaagaagcaauucgacauacgcgagguauaucucguacuggcccacaugaucaaauacagaggaaacuucuuaauggaaggagacguaaaggacucagucguggacccaaccuaucugaagcagugcuucgacaacaucgacgucauacugaucucccucaacaacggagaagacgaugaaaaugaggacgacaaaaucgacccaucagaauguuguuuuaacgucgacgagaagaaagcccgaaaacuugcuaacaacuuccaggaaacaaacaaaguuagcgaccuagaggaugacgagagagaccucuucgguaaauucaacucaaaagacauccgcaaaaagauccuaaagcucaucaaugguggcagcggaguaaagcuaaaagacuuccugccuaaggaaauccuaguggcgcacgauggagacgacgaguacggagauaagaaaauagaccuaucgagcgagacgcuggaagacgacauaaacgguuacagccucccggaaucauacguagaaauaauuuuggaagccaagaaaaucuaugauuucaaaacgcucgcguaccugcuucacggaaagagcuuacugugcgacgcgauggucaaugucuacgaggaacacaaagaacaacucgcagcacuaaaacgacucuacaagaaauacgccacgaaagagcaauacuacuucauguucagagacagcaggauucuugacggggaugauagcgacgacgaagaggacaaagaagaguccaacaaggaagagucuaaagacaaaaagaaaaaggccagcuacguaaguuacaucggcuacaccaaaaccaauagcaaagccaaauacacaggcgcgcacaucaccagugagaagaacaucagcgcccucaucaaacagaucaaagacgaccuaaaauucgacgaccuaaagaguaaaguagaugacccaucccaacagaacgaguuaagcgacgaagacaaacuagauauccaguguauagaagaagccaucgaguccaacacuuuccucccccggcaaaacagcagaaacaacggcgccuucccauaccagcucaaccuuaacgaaaugcgcaccaucauugaaaaccagucgaaauacuacccauuccugaaagacaaagcccccucuuuccccgacggcaaaacagaggaguacaaaaucgucagccugcucaaauucaagauccccuacuacaucgggccacucagccagcccaacgacuacguacgcgacgauaagcgggacaaccacuggguccaguuccgcggcgagaacaaucaagggauuauaaaccccuggaacuucagccaaauuguagaccucgaaggaacggccgacaaauucaucuccaaccuaacuaacuacugcacguacauauucggcgagaacacccuuccgaaagagucacucaucuuccaagccuacaaggugcucaaugaccucaauaaccucaaggucaacgguagccucaucuccaaagaggacaaggacuacaucauccaaaaugucuaucucaagaaaaagaaaaucaaaggcaaagacaucguaaacgcgcucaagaacaaauacaagcucagcgaugaagaccccaccguaaccacaaaaggcuccggcaaaaguauaggcgaggacgaagucgaccucacaauguucaacaguucucucucguccuucaucgauaugucagaccccaacgcauucgguccagaguucuauaaggacagcaauaaauucgaacucgccgaaaaggucaucgaguuaauuaccaucgucgaagacaaagaccuacugaaggaacgccuuaagaagcugggucuaucagacaaucagguaaauuaccucuucaaacagaaauacucugguugggcccccuuaucacggaaacuauuggacgguauaacaauugacugcgucaaugagaauacgggagaagcguaccccgucacuaucauagacgucaugcgcgauacgccgcugaacuuuauggagaucuacgaaacaaaagaaagccaauuuuccggcuucaaggagaaagucgcagaacuaaacgaugaaaagaaacugucgcgagacgaccucauagaagaaagcuacgccagcccagccaugaaaagaucgguacgccaaaccuucaaggucauagacgaacucaaaaacacacuaaacauugaccacuucgacaggauauuuguagaagcaacgagggcccccggagaggcggggaaaaugguuaaaagucgaaagaaacagcuccaagaagccuaugacgcggcaaaagaccucguggaccaagaaucucgagacgaccuccaaaaacugagggacgaccuagaaaaacagacugacgaccagcuucgacggaaaaagguguaccuauacuucaugcaguuagguagauccguuuacagcggggagaaaauugaucuaaacgagcucgacaagaauuacgacauagaucauauaauaccacaggccaaauuaaaggaugacagcuucaacaacaugguccugguggaacgagaacugaacaacaagaaacaagacgaauaucccauacccuccaccaucaucuccgagcauggucgaaacuggauccaaaaacuggccaaaauacaggacaagaacaagcggagcuauuucaugcccaaggauaaagcgaaucggcuccuccgcccagaaucaaaacaacuaaccagcgacgaacucaacggcuuuauaaaccgccaacucacccuaaccaaccaauccguaaaagcagucugcgacauacugaaaaugacugaaaaaggcuccgagauagucuacucaaaagccaacuuugucuccgacuuucgcaaacuaugcggcgaacuacggcccagcuaugacgccuuuguaaaagugcgggacauaaacgacuuccaccacgcaaacgacgccuacuuaaauauaguggucggaaacguauauuaugagaaauuuaagaacuucuacauaaacaaccgaauagacuacgacaacaacggcaaaaaggaccuuucaguccuagccagcaagcuauucacgaaaacacaggccgacgacaagacaggaaacauuuacugggaagcgcgauuccacaaugaaaaggaaacugacucaaauggcaaggagcguacaauaaaaguccgcgacgaaggaacugaaaguacguucgacaaaaucgaauacuauauggagcucaacgacccacucgucacacaaaugcaguacacccucucaggcaaacaaggguucuucaaaaagauaacccugaaaaccaaggccaaagacaaugaggacaacagcgacaaacucuucccgcucaaacaauaccuacggagcgacucaaacaaagucauggauguuaacaaauacggcggcuacagcgacaugauaacgccauacuucaugcugguucaaagcgaaggcaagaagggaaagcacaucuacucgcuugaauccauuccgacaauauaccuaaaaucguucaagaaaaaggaagaagacauuaucaauuaccugucuuguaaaaacaagcuaaagaaccccguagugaucucugacaagcuacugaugagaacgauuguaaaaauaccauacuucaagaacgacuccaaccuaagucuagucaaacuaggcacaagcggacgaaccggcaacaacauaaucuacauaaaccuuagcgaacucauauuaccaaucgaguggaaaaacuauuacagaaaaauaucaaacuugcuggguaccaacgucucgucgacuaaacccaaagaucucagcaaauucaccgaacaaaugaaaaacgacccaacaucaacccuaguagacgggaguaacaaaguagaacacgacaaaaacaacagguucuucagcuaccugauaaacaacgucaucaacaaacccauauucgaaggucuccccaagacaucuugcaguuucaucaaacuugaauccaaauacgacgaguucugcucgcuaaacacauuagaacaggcaaaaauaaucgcgacaauuaucaagcuacucagcuguaaauccguccaaggcugcaaacucucaaaccucucgggauugcccucgucacuaggcgcccucauaaguaacaaagcccucaccgaaggcaccauaaucucaaaagaaucaagcugcggacugaaggaaaacaucaucuucguagucccuaacgacuga

SEQ ID NO: 6937 - RNA, 5067 nt, Artificial Sequence
  Cas9 variant
auggaguucaagaaaguccucgggcucgacaucggaacaaacagcauagggugcgccuugcugagccuccccaaaucaauccaagacuauggaaaaggcgggaggcuugaauggcucacaagccgcgucauaccacuggacgccgacuacaugaaagccuucaucgaugggaaaaacggccucccccagguuauaacuccggccgggaaacgccggcagaaacgaggaucacgcagacuuaaacaucgcuacaaacuacgccguucaagacuuauccggguguucaagacacuaaacuggcugccggaagacuucccccuagacaauccuaagcgcauaaaagaaacaauaucaaccgaaggcaaguuuucauucaggauuucggacuacguuccgaucucagacgaaagcuaccgagaguucuaccgcgaauuuggauacccagaaaacgaaaucgaacaagucaucgaagaaauaaacuuccgccggaaaacgaaaggcaagaacaagaauccaaugaucaaacuccucccugaagacuggguaguuuacuaccuuagaaagaaagcgcucauaaagcccacuacgaaggaagaacucauccgaauaaucuacuuguucaaccaacgacgggguuucaaaucuucccgaaaagaccucaccgaaacagcgauacucgacuacgacgaguucgccaagcgccuagcagaaaaggaaaaguauucggccgaaaacuacgaaaccaaauucgucucaauuaccaaggucaaggaagucguagaacucaaaaccgacggucgcaagggaaagaaacgauucaaagugauccuggaagacagcagaaucgaacccuacgaaaucgagcgaaaagaaaaaccggauugggaaggcaaggaguacaccuuccucguaacacaaaagcuggagaaaggcaaguuuaaacagaacaaacccgaccugccaaaagaagaagauugggcccugugcacaaccgcccucgacaacagaaugggauccaagcacccgggcgaguucuucuuugaugagcuccuuaaagcauucaaggaaaaacguggguacaaaauccgccaauacccagugaaccgcuggcgcuacaagaaagagcucgaguucaucuggacaaaacaaugccaacugaacccagagcugaacaaucucaacauaaacaaagagauucuccgcaagcuggcgaccguucucuaccccucacaauccaaauucuucgggcccaaaauaaaagaguucgaaaacagcgacguccuccacaucauaucugaggacaucauauacuaccaacgcgaccucaagucucagaaaagccucauauccgagugccgcuacgaaaaacgcaaggguauugacggcgaaaucuacggucugaagugcauccccaagagcuccccgcuuuaccaagaguuccgcaucuggcaagauauccacaacauaaaaguuauucgaaaagaaagcgagguaaacggcaagaagaaaauaaacauagaugaaacccaacuauacaucaacgaaaacaucaaggagaaauuauucgaacuauucaacucaaaggacucccuauccgaaaaagauauccuggaguugauaucccuaaacaucaucaacaguggcauuaagaucuccaagaaagaggaagaaacuacacacaggaucaaccuauucgcaaaccgaaaagaacucaaaggcaacgaaacgaaaucacguuaucgaaaaguauuuaagaaacuaggcuucgacggugaauacauucugaaucacccaagcaaacucaacagacuguggcacucugacuacucgaacgacuacgcagacaaagagaaaacggagaaaagcauacuaucuucacugggauggaaaaaccgcaauggcaagugggaaaaaucuaagaacuacgacgucuuuaaccucccacucgaagucgcgaaagcaaucgcaaaccuaccuccucucaagaaagaauaugggucguacuccgcccuagcgauccggaagaugcuagugguaaugcgggacggcaaauacuggcaacacccagaccaaauagcaaaagaccaagaaaauacaucacucaugcuuuucgauaagaaccuaauacaacugacaaauaaccaacgcaaaguccugaacaaauaccuucucacccuagccgagguacaaaaacguaguacccucaucaaacaaaaacugaacgagaucgagcacaauccguacaagcucgagcuaguaagcgaccaggaccuugaaaagcaaguacugaaaucuuuccucgaaaagaagaacgaaagcgacuaccucaagggcuugaagaccuaccaagcgggguaccucaucuacgguaagcacucagagaaagacguacccaucguaaacagcccagacgaacuaggagaauacauaagaaagaaacugccaaacaacucccuccgcaauccuauugucgaacaagucauccgcgagacuaucuucauuguccgugacguuuggaaaaguuucggaaucauagacgagauccacaucgaacuuggccgcgaacucaagaacaacagcgaggaacggaagaagaccagcgaaagccaagaaaagaauuuccaggaaaaagagcgcgcgcgcaaacugcuuaaggaacugcucaacucuagcaacuucgaacacuacgacgagaacggcaacaagaucuucucuuccuuuacagugaacccaaaucccgacucgccgcucgacauugagaaguuuaggaucuggaaaaaccaauccggacugaccgacgaggagcucaacaagaaacuaaaagaugagaaaaucccaaccgaaauagagguuaagaaguacauacucuggcucacccagaaaugccgcagcccauacacuggcaaaauaauucccuuaagcaaacucuucgacucaaacgucuacgaaauugaacauauaaucccacgcagcaaaaugaagaacgacuccaccaacaaccuuguaaucugugagcuaggcgucaacaaagccaagggcgaccgccucgccgcgaacuucaucuccgaaagcaacggcaagugcaaguucggagaaguagaauacaccuugcuaaaguacggcgacuaccuacaauacugcaaagacaccuucaaauaccagaaggccaaauacaagaaccuccuugccaccgaacccccggaagauuucauagaacgccaaaucaaugacacccgcuacauaggccguaaacucgccgagcuucuuacucccgucguuaaggacagcaaaaacauuauauucaccaucgggaguaucacaagcgagcucaaaaucaccuggggucugaacggggucuggaaagacauccugcgucccagauucaaacgucuagaaaguaucauaaacaagaagcugauuuuccaagacgaggacgaccccaacaaguaccacuucgaccucuccaucaacccgcagcucgauaaggaaggucugaaaaggcucgaccauagacaccacgcgcucgacgccacgaucauugccgccaccacccgggaacauguaagguaccucaacucccugaacgcagcggacaacgacgaagaaaagagagaauacuuccucucacuaugcaaucacaaaauacgcgacuucaagcugcccugggagaacuucaccagcgagguaaaaucaaaacuauuauccugcguuguaucguacaaagagagcaaacccauacucagcgauccauucaacaaauaccuaaagugggaauacaaaaacggcaaauggcagaaagucuucgcgauucagaucaaaaaugacagguggaaagccgugcgucgcagcauguucaaggaacccauaggaaccguguggaucaagaaaauaaaagaggucagccucaaagaagccaucaaaauacaagccauaugggaagaagucaagaacgaucccguacggaagaagaaggaaaaguacauauacgacgauuacgcacaaaaaguaauagccaagauaguccaggagcugggacugucaucaagcaugcgcaagcaagacgaugagaaauuaaacaaguucauaaacgaagccaaagucucggcugggguuaacaagaaccuaaacacaaccaacaaaacaaucuacaaccucgagggccgcuucuacgagaaaaucaaagucgccgaauacgugcucuauaaagcgaaacggaugccacucaacaagaaagaauacaucgagaaacucagccuacagaaaauguucaacgaccuaccaaacuuuauccucgagaaauccauccuagacaacuaccccgaaauccuuaaagagcuugagucggacaacaaauacauaauagagccccacaagaaaaacaacccugugaaccggcuacuucucgaacacauacuagaguaccacaacaacccgaaggaggccuucagcaccgaaggccuggagaagcucaacaagaaagcaauuaacaagaucgggaaacccaucaaguacaucacacgacuagacggagacauaaacgaggaggagauauuuaggggcgccguuuucgagaccgacaaaggaucgaacgucuauuucgucauguacgagaacaaccaaacgaaggaccgagaguuccucaaacccaacccaucgaucucagugcuuaaagccauagaacacaaaaacaagauugacuucuuugcacccaaucgccucgguuuuucccgaauuauacuaucucccggugaccuagucuauguuccgacaaacgaccaguacguacugauaaaagacaacagcagcaacgaaaccauuauuaauugggacgacaacgaguucaucagcaacaggaucuaccaagugaaaaaguucacaggcaacucauguuacuuccucaaaaacgacaucgccucccuaaucuuaucguacagugcaucgaacggcguaggggaguucggcagccagaacaucagcgaauacagcgucgaugaucccccgauccggauaaaagacguguguaucaaaauacgcguagaccgacugggcaacgucagaccgcuguga

SEQ ID NO: 6938 - RNA, 3924 nt, Artificial Sequence
  Cpf1 variant
augacccaauucgaaggauucaccaaccucuaccaagugucgaaaaccuuacgcuucgaacucaucccgcaaggcaaaacacucaaacacauacaagaacaaggguucauagaggaggacaaagcaagaaacgaucacuacaaagaacucaaaccgaucaucgaccgaauauacaagacuuacgccgaccaaugccugcaacucguccaacucgauugggagaaccuguccgcagcuaucgacuccuaucgcaaagagaaaaccgaagaaacgcgcaacgcacuuauagaagaacaagcgacguaccgaaacgcaauccacgacuacuucauaggccgcacagacaaccugacugaugcaaucaacaagcgacacgcagaaaucuacaaaggacuguuuaaggccgaacucuuuaacggcaaaguccucaagcaacuaggcacagugacgacgaccgaacacgagaaugcccuccuacgguccuucgauaaauucacuacguacuucuccggcuucuacgaaaacagaaagaacgucuuuuccgccgaagacauaucgacggcuauaccccaccgcauagugcaagacaacuuucccaaguucaaagaaaacugccauaucuucacccggcuuauuacagccguuccgucacuacgcgaacacuucgagaacguuaaaaaggcaaucggcauauucguaucaaccucaauagaagaggucuucagcuucccauucuacaaucaguuacucacacaaacccaaauagacuuguacaaccaacuuuugggagguauaucaagggaagcaggcaccgagaaaaucaaaggacuaaacgaaguacuuaauuuggccauccagaaaaaugacgaaacugcccacaucauugcuucacuaccccaccgguucauaccgcuuuucaagcaaauucucuccgaccgaaauacccucuccuuuauccucgaagaguucaaauccgacgaagaaguaauccagagcuucuguaaauacaaaacacuacuacgcaacgaaaacgugcuagaaacagccgaagcccucuucaacgaacucaacagcaucgaucuuacucacaucuucaucagccacaagaaacucgaaaccauauccagcgcccuuugcgaucacugggacacccugagaaacgcacuauaugagcgccguauauccgagcucaccggcaaaaucaccaaguccgccaaggaaaagguccaacguucccuuaaacacgaggacauaaaccuccaagaaauaauuagugccgcuggaaaggaacuaucagaagcauucaaacaaaagaccucggaaauacuuucccacgcucacgccgcgcuagaccaaccgcuaccuacgacccucaaaaagcaagaagagaaagagauccuaaaaucccaacuagacucacuccuaggacuguaccaucuccucgacugguucgcaguggaugaaaguaacgaaguugacccagaguucagcgcucgccugacuggcaucaagcucgagauggaaccuucguugaguuucuacaauaaggccaggaacuaugcuaccaaaaagccauacucggucgagaaauucaaacugaacuuccaaaugcccacgcuggcgagcgggugggacgucaacaaggaaaagaacaacggcgcaauacuauucgucaagaacggacuuuacuaccugggcaucaugccuaaacaaaagggccgcuacaaagcacucucauucgaacccaccgagaaaacaagcgaaggcuuugacaaaauguacuacgacuacuucccagacgcagccaaaaugaucccaaaaugcagcacccaacucaaagccgucacagcccacuuccagacacacaccacgcccauccuacuguccaacaacuucaucgaaccccuugaaaucaccaaagaaaucuacgaucugaacaacccagagaaagaacccaagaaauuccaaaccgccuacgcaaagaaaacaggcgaucaaaaaggguaccgagaagccuuaugcaaauggaucgacuucacgcgcgacuuccuaagcaaauacaccaaaacuaccucaauugaccuuagcucccuacgcccauccucacaauacaaagaccucggagaguauuaugccgaacuaaacccccuccuauaccacauuucuuuccagcggaucgccgagaaggaaaucauggacgccgucgaaacagggaaacucuaccucuuucagaucuacaacaaagacuucgccaaaggccaccacggaaagccuaaccuucacacgcucuauuggaccggccuauucuccccagaaaaucuagcaaaaacauccaucaagcucaacggucaagccgagcucuuuuaccgccccaagucccgcaugaaaagaauggcgcacagacuuggcgagaaaaugcuuaacaagaaacucaaagaccaaaagacucccauuccagacacgcucuaccaagaacucuacgacuacgucaaccaccgacugucucacgaccuuuccgacgaagccagggcacuccucccaaacguaaucacuaaagaggucagccaugagaucauaaaagaccgacguuucacgagcgauaaauucuucuuccacguacccaucacacuuaauuaccaagcagccaacucaccauccaaauuuaaccaacgcgucaacgccuacuugaaggaacaucccgaaacccccaucaucggcaucgauagaggcgaacguaaccugaucuauaucaccgucaucgacagcacgggaaaaauacucgaacaacgaucccuuaacaccauacaacaauucgacuaccagaaaaagcucgauaaccgagagaaggaacgaguagccgcacgucaagccuggucgguugugggaaccaucaaagaccucaagcagggauaccucucacaaguaauccacgaaauaguagaccucaugauccacuaccaagcggucguaguacucgaaaaccucaacuucggcuucaagucgaagcgaaccggaaucgccgaaaaagccguauaccaacaauucgagaaaaugcuuauugacaagcucaacugccuuguccuaaaagauuacccagccgaaaaaguaggaggaguacugaaccccuaccaacucaccgaccaguucaccucauuugcuaaaaugggcacccaaucaggauuucuuuucuacgugcccgcucccuacaccagcaaaaucgacccauuaaccggcuucgucgaucccuuuguauggaaaaccaucaaaaaucacgaaagccguaaacauuuccucgaaggcuucgacuuccuccacuacgacgucaagaccggagacuucauccuacacuuuaagaugaacagaaaccucagcuuccaacgcgggcuaccgggcuucaugcccgccugggacauagucuucgaaaagaacgaaacacaguucgacgcaaaaggaacaccauucaucgcaggcaaacgaauugucccgguaaucgaaaaccaccgauucacaggccgauaccgggaccuguaccccgccaaugagcucaucgcccuccucgaagagaaaggcaucgucuuccgagauggcuccaacauccucccaaagcuccucgagaacgacgacucacacgccaucgacaccauggucgcucugauccgcagcguacuacagaugcgcaacuccaaugccgcaacaggagaagacuacaucaauucaccagucagagacuugaacggggucugcuucgauucgcgguuccagaacccagaauggccuauggacgcagacgcaaacggcgccuaccacaucgcucucaaaggucaacuccuacuaaaucaccuaaaagaaucuaaggaccuaaagcuacagaacggaauauccaaccaagacuggcuagccuacauacaagagcuucgcaacuga

SEQ ID NO: 6939 - RNA, 3903 nt, Artificial Sequence
  Cpf1 variant
auguccauauaccaggaguucguaaacaaauacagcuuauccaaaacacuccgcuucgaauugauaccccaaggaaaaacucucgagaacauaaaagcacgagggcucauacucgaugaugaaaagcgagcaaaggacuacaagaaggcaaaacaaauaauagacaaguaucaccaguuuuucauagaggagauccuauccucagucugcaucagugaagaccuucuccaaaacuacucagaugucuacuucaaacuaaagaaaucugacgaugacaaccuccagaaggauuucaaauccgccaaagacaccaucaaaaagcaaauauccgaguacaucaaagauucggaaaaauucaaaaaucuguucaaccaaaaccugaucgacgccaagaaaggacaggagagugaccucauacuguggcuaaagcagagcaaagacaacggcaucgaacuauuuaaagcgaacucugacaucaccgauaucgacgaggcgcuagaaauaaucaaaucauucaaaggcuggacuaccuacuucaaaggguuccacgaaaaucgcaagaacguguacuccucaaacgacaucccgaccuccauaaucuaccgcauaguggacgacaaucugcccaaauuccuugagaacaaagcgaaauacgagucauugaaagacaaagccccugaagccauaaacuacgagcaaauuaaaaaggaucucgcggaggagcucaccuucgacauagacuacaaaaccucagaagucaaccaaaggguguucucccuagacgaaguauucgagaucgccaacuucaacaacuaccuuaaccaaucgggaauaacgaaguuuaacaccaucauaggggguaaauucgucaauggcgaaaacaccaagcgcaagggaaucaacgaauacauuaaccucuacucccagcagauaaaugacaaaacgcucaagaaauacaagaugagcgucuuauucaagcaaauacuaucagauacagaauccaagagcuucgugauagacaaacucgaagacgacuccgacguaguuaccaccaugcagagcuucuacgagcagauugcagcguucaaaacaguugaagagaaguccaucaaggagacguugucccuccucuucgaugacuuaaaggcgcagaaacuagaccucucuaaaaucuacuucaaaaacgauaaaagccuaaccgaccuaucccagcaaguauucgacgauuacucagugaucggaacagccguccuagaauauauaacccagcaaauagcacccaagaaccuggacaauccaagcaagaaagagcaagagcugauagccaaaaagaccgaaaaagcgaaguaccucucccuggagaccaucaaguuagcgcuugaagaguucaauaagcaccgagacauugacaagcagugcagauucgaagaaauccucgccaauuucgccgccauccccaugaucuuugacgaaaucgcccaaaacaaggacaaccuggcacaaauauccauaaaguaccagaaccaaggcaagaaagaccuacuacaggcaagcgccgaagacgacgucaaagcgaucaaagacuuacuggaccaaacuaacaaccuacuacauaagcucaaaauauuccacaucucgcagucggaagacaaagccaacauccuagacaaagacgagcauuucuaccuagucuucgaggaguguuacuucgaacuugccaacaucgucccguuauauaacaaaauccgcaacuacaucacccaaaaacccuacucagacgaaaaguuuaaacuuaacuucgaaaacucaacccuggcaaacggaugggacaagaacaaggaaccagacaacacagccauccuuuucauaaaagacgacaaauacuaccucggagugaugaauaaaaagaauaacaaaaucuucgaugacaaagccaucaaagaaaacaaaggggagggcuacaagaaaauagucuacaaacuccugccgggugccaacaaaaugcuccccaagguauucuucucugccaaauccaucaaguucuacaacccuuccgaggauauauuacgaauuaggaaccauuccacccacacaaagaacggcucaccccaaaaaggcuacgagaaauucgaguucaauaucgaagacugucgcaaguucauugacuuuuacaagcagagcauaucaaaacaucccgaauggaaggacuucggguuucgcuucagcgacacucaacgcuacaacucgaucgacgaguucuacagagaagucgaaaaccaaggcuacaaacucaccuuugagaacauaucggaaucguacauagacagcguagucaaccaaggcaaacuauaccuguuccaaauauacaacaaggacuucucugcauacagcaaaggccgaccaaaccugcacacacucuacuggaaggcucucuucgacgaacguaaccugcaagacgugguauauaaacuuaacggcgaagcugaacucuuuuaccgaaagcaauccauccccaagaagauuacacauccagcaaaagaggccauagccaacaagaacaaagacaaccccaaaaaggagucaguauuugaauacgaccucaucaaagauaaacgcuucaccgaagacaaauucuucuuccacugccccauuacgauaaacuucaaaucaucuggcgccaacaaauuuaacgacgaaaucaaccugcuccuaaaagaaaaggccaacgauguacacauacuaucgauagacaggggcgaacggcaccucgccuacuacacgcucgucgacggaaaaggaaacaucaucaagcaagacaccuucaacauaaucggcaacgaccgcaugaaaacgaacuaccacgacaagcuagcagcgauugagaaggaccgagauagcgcacgcaaggacuggaagaaaaucaacaacaucaaagagaugaaagaaggguaucucucccaagucguccaugaaauagcgaaacucgucaucgaauacaacgccaucguaguguucgaagaccuaaacuucggguucaaacgaggacgauuuaaaguggaaaaacaagucuaccaaaaacuagaaaagaugcuaaucgagaagcugaacuaccucgucuuuaaagacaacgaguucgacaaaaccggaggaguguuacgcgccuaucaacucaccgccccauucgaaacguucaaaaagaugggcaaacaaacaggcauaaucuauuacguucccgccggcuuuacuucaaaaauaugccccgugaccggcuucguaaaccaacucuaccccaaguaugaaagcguaucaaaaucucaagaauuuuucagcaaauucgacaaaaucugcuacaaccuggacaagggauacuucgaguucuccuucgacuacaagaacuucggggacaaggccgcaaaaggcaaguggaccaucgccuccuucggcagccgccucauaaacuuccgcaauuccgacaaaaaucauaacugggacacacgagaagucuauccaaccaaagagcuagagaaacuccucaaagacuacuccauagaguacggucacggcgaguguaucaaggccgccauaugcggagaaagcgacaagaaauucuucgccaaacugaccucuguccuaaacaccauucuccaaaugcgcaauuccaaaaccggcacugaacucgacuacuuaauaucccccguagccgaugucaacggcaacuucuucgacagucgacaagcgccuaagaacaugccgcaagacgcggacgcaaacggcgcguaucacaucggccuaaaaggccugaugcugcucggacgaaucaaaaacaaccaggaaggaaagaaauugaaccuagucaucaaaaacgaagaauacuucgaguucguccagaaccgcaacaacuga

SEQ ID NO: 6940 - RNA, 1341 nt, Artificial Sequence
  Cpf1 variant
augaaaccagacaucaaagaccgcgaauacauguaccgacucaucauuggacaacucuucuacgacggucaccaacaaauagcagucaaucucgcaaacacccuaggaugcucagccccacccccaccacccucagacaaacucuuccgacuugucaccaucgccaaacaauucguugaagaccccgacuacaaagccgaggaaaacaccaugcccaugcaauucgaaaccucaucagccggacucgaccuacaauacgacgccgacguugccgcgaccucacccgaacccagccaauaugaaaccauauaccuaaccguacacaaagcacccugccgagccgcagccuucaacuccgauggaucccuaaucgcgacaggcuccgccgacugcucaaucaaaaucauggacgucgaacgaauccucgcacgagaaaaagaacaccgcgaaaugaacgaaaacggacccgacgcacaucaccccguaauccgcacucucuacgaccacgucgacguccgccgcgauuucggcagauucagcgacaaaauccuagacuuccaagacgucaacaccguaauauuccacccccgagacgccauccuaauaagcggcuccaacgauaaaaccgucaaacucuucgacuucagcaaaacugcagucaaacgcgccaugaaaacccucucagaggucuaccccguacgagcacucagcugccacccaggaggugaguuccuacucgucgccaccgaccaccccacaguccgccuuuacaacauagaaacggcccaagcauacgccagcgccaaccccgacgaccaacaccgugaaucagugacagacguccacuacuccgaaaaugcacgacuauacgucacagccagcaaagacggcgauguaaaagucugggacggcgucuccucccgaugcgucgaaaccuuuaaaagagcccacgacggauccuccaucugcucagcaaaauucaccaaaaacggcaaauauauacucacauccggcauggacuccaucgucaaacucugggaacucucaacaaaccgaugccuaauagucuacacaggcgcaggagcgacaggcgcacaagacuaccccaccucagccuccuucaaccaaaacgaagacuucguccucuucccugacgaaaaauccggcuccaugugcuccugggaagcacgcaacgccgaccgcaaaagacuccucgcccucggccacaccagcgccugccgaaccuucguccacucccccuccaugcccgccuucaugacaggcuccgacgaccaucgcgcacgauucugguaccgaaaacccaccacaaacgacaacuga

SEQ ID NO: 6941 - RNA, 1293 nt, Artificial Sequence
  Cpf1 variant
augaagccugacaucaaggaccgagaauacauguaccgccuaaucaucggucaacucuucuacgacggccaccaacaaauagcagucacccucgcuaacacacucggcugcuccgcacccgcacccccaccaucugacaaacucuaccgccuagucacaaucgccaaacaauucguagaagaccccgacuauaaagccgaagaaaaaucccuacccaugcaauucgaaaccgucuccacaggccucgaccucgaauacgacgccgacguccaaccaguauccccagaaccaucccaauacgaaacaauauaucucaccguccauaaagcccccugucgcgccgccgccuucaauucagacggcucccucgucgccaccggcuccgccgacugcuccaucaaaaucauggacguagagcguauccucgcaagagaaaaggaacaccgagaaaugaacgaaaacggcccagaugcccaccaccccgucauaagaacccuauacgaucacgucgacgacguuaacaccguccucuuccaccccagagacgcaauacucaucuccggaagcaacgacaaaacagucaaacuauucgacuucuccaaaaccgccguaaaacgggccaugaaaacccucucagaagucuaccccguacgcgcucuaucaugccaccccggcggagaguuccuccuagucgccaccgaccaucccaccgucagacuauacaauauagaaaccgcacaagccuacgcuuccgccaacccagacgaccaacaccgagaauccgucaccgacgugcauuacucagaaaacgcccgacuauacguuaccgccucuaaagacggugaugucaaaaucugggacggagucagcaaccgcugcgucgaaacuuucaaacgcgcacacgacggauccgccaucugcucggccaaauucaccaaaaauggcaaauaccuacucaccuccggcauggacuccaucguaaaacucugggaacucuccacaaaccgaugccucauagucuacaccggcgccggcgcaaccggcgcacaagacuacgccaccucagcauccuuuaaccacaacgaagacuacguacucuucccagacgaaaaauccggcuccaugugcucuugggacgcccgcaauucagaccgcaaacgccuccucgcccuaggucacacuuccgcaugccgcaccuuuguucacucaccauccaugcccgccuucaugaccggcucagacgaccaccgagcccgcuucugguaccgcaaaccagcaaccaccgacaacuga

SEQ ID NO: 6942 - RNA, 3690 nt, Artificial Sequence
  Cpf1 variant
auggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaaguga

SEQ ID NO: 6943 - RNA, 3903 nt, Artificial Sequence
  Cpf1 variant
auguccauuuaccaagaguucguaaacaaauacucgcucucgaagacauuacgcuucgaacuaaucccgcagggaaaaacacucgaaaacauaaaagcccgcggccucauccuggaugacgagaaaagagccaaggacuacaaaaaggcaaaacagauaauagacaaauaucaccaauucuucaucgaggaaauucuaagcucugucugcaucagcgaagaccuccuccaaaacuacagugacgucuacuucaagcucaagaaaucagacgacgacaaccuacaaaaagacuucaaauccgcgaaagacacuauuaagaaacagauaagcgaauacauaaaagacucugaaaaauucaaaaaccuuuucaaccagaacuugauagacgcuaagaaaggccaggaaucagaucucauucuguggcucaagcaaucgaaagauaacggaaucgaacucuucaaagccaacucagacaucaccgauauugacgaagcacuggaaaucauaaaauccuucaaaggauggaccacauacuucaagggauuccacgaaaaccgcaagaacguauacucgagcgacgacauccccacuagcaucaucuaccgaaucguggacgacaaucucccgaaauuucuagagaacaaggcaaaauacgaaucccuaaaagacaaggcgcccgaggccaucaacuacgaacagaucaaaaaggaccuugccgaagaacucacguucgacaucgacuauaaaacaucggagguaaaccagcggguuuucagccucgacgaaguguucgagauugccaacuucaauaacuaccuuaaccagucuggcauaacuaaguucaacacuauaaucggcgggaaauucgucaacggagaaaacacaaaacggaaaggaaucaaugaauacaucaaccucuacucccaacagaucaacgauaagacacucaagaaauacaaaauguccguccuguuuaaacaaaucuuguccgacacagaaagcaaauccuucguaaucgacaagcucgaagaugauagcgacgucgucaccacgaugcagucuuuuuacgaacaaaucgccgcauucaagacagucgaagagaaaucuaucaaggaaacacuaucgcuccuguucgacgaucugaaggcccaaaaacucgacuuauccaaaauuuacuucaagaacgauaaaucacuaacagaccucagccaacagguguuugacgacuacagcgugauaggaaccgcaguccuagaguacauaacccaacaagucgccccuaaaaaccucgauaauccaucaaagaaagaacaagaccuaaucgcgaagaaaaccgagaaagcaaaauaccucagucuggagaccaucaaacucgcauuagaggaguucaacaaacaucgcgacauagauaaacaaugccgauucgaagaaauacuugccaacuuugcugcaauaccaaugaucuuugaugagaucgcacaaaacaaggauaacuuggcccagaucucccucaaauaccaaaaccaggguaagaaagaccugcuccaggccagcgccgaagaagaugucaaagccaucaaagaccuucuggaucaaaccaacaaccuccuacaccgccucaaaauauuccacauuucccaguccgaggacaaagcgaacauccuagacaaggacgagcacuuuuaccucgucuucgaagaauguuacuucgagcuugcaaauauaguaccacucuacaacaaaauucggaacuacaucacccaaaaacccuacucagacgagaaguucaaacugaacuucgagaacucaacacuagcaaacgggugggacaaaaacaaagaaccagacaacaccgccaucuuauucauaaaggacgacaaguacuaccucggugucaugaauaagaaaaacaacaaaauauucgacgacaaagccaucaaagagaacaagggcgaaggcuacaagaaaauuguguacaaacuccugcccggagcuaacaaaaugcugcccaaagucuucuucagcgcaaaaucaaucaaauuuuauaaccccuccgaagacaucuuacgaauaagaaaucacucuacccacacgaagaacggaaacccgcaaaaagguuacgaaaaguucgaguuuaacauugaggacugccguaaauucaucgacuucuacaaagaguccaucucaaaacaucccgaauggaaagacuucggcuuccgcuucagcgacacccaacgcuacaacagcaucgacgaguucuaccgcgaggucgagaaccaaggauauaagcuaacauucgagaacaucuccgagagcuacaucgacagcguggucaaccaggggaagcuauaccuguuccaaaucuacaacaaagacuucucagcguacucaaaggggcgaccaaacuugcacacgcucuauuggaaggcucuauucgaugagcgcaacuuacaggacguagucuacaagcuaaacggagaggccgaacucuucuacaggaaacaaagcaucccgaagaaaauaacgcacccagccaaagaagcgaucgcaaauaaaaacaaagacaacccgaagaaggaaucagucuuugaauacgaccuaaucaaagacaagcgcuucacugaggacaaguucuucuuccauuguccaaucacaaucaacuucaaaagcucgggggcaaauaaguucaacgacgaaauaaaccuccuacucaaggaaaaggcgaacgacguccacauccucucaauagacagaggggagcgccaucuugccuacuacacucuugucgauggaaaaggcaacauaaucaaacaagacacuuucaacaucaucggaaacgaccguaugaaaaccaacuaccacgacaaacucgccgccauagagaaggaccgcgacucagcucgcaaggacuggaagaaaaucaacaacauaaaggagaugaaagagggcuaccuuucgcaggucguacaugaaaucgcgaagcuagucauagaacacaacgcuaucgugguauucgaagaccuaaacuucggguucaaacgcggccgauucaaaguggaaaaacaaguauaccaaaaacucgaaaagaugcucaucgagaaacugaacuaccucguauucaaagacaacgaguucgacaaaaccgguggaguccugcgcgccuaccaacucaccgcgcccuucgaaacuuucaaaaagaugggcaagcagacaggcaucauauacuaugucccagccggcuucaccuccaagauauguccagucacgggauucgucaaccaacucuaccccaaauacgaauccgucuccaagagccaggaauuuuucagcaaauuugacaaaauaugcuacaaccuggacaaaggcuauuucgaauuuagcuuugauuacaaaaacuucggcgacaaagcggccaagggaaaauggaccauagccagcuucggaucacgcuugaucaacuuccggaacagugacaaaaaccacaacugggauacgcgagaaguguacccaacgaaagaacuagaaaaacuccucaaagacuacucgauugaauacggucauggcgaaugcauaaaggcagcaauuugcggugaauccgacaagaaguucuucgcaaaacucacgucuguacucaacacaauccuacagaugcgcaacagcaagaccgggaccgagcuagacuaccucaucucccccguggcggacguuaacggaaacuucuuugacagccgacaagcaccaaagaacaugccccaagacgccgacgcaaacggcgcguaccauaucgggcucaaaggccucaugcuccuagaccgcauuaaaaacaaccaagaggggaaaaagcucaacuuagugaucaagaacgaagaauacuuugaguucguucagaauagaaacaacuga

SEQ ID NO: 6944 - RNA, 1071 nt, Artificial Sequence
  Cpf1 variant
augaaaaccaacuaccacgacaaacucgccgccaucgaaaaagaccgagaaagcgcgcgaaaagacuggaagaaaaucaacaacauaaaagaaaugaaagaaggauaccugucccaggucguucacgaaauugccaaacuggucauaggcuacaacgcgauaguggucuucgaagaccucaacuucggguucaaacgcggccgcuucaaaguagaaaaacaagucuaccaaaaacucgagaaaaugcuaauagaaaaacuaaacuaccucgucuucaaagacaacgaauuugacaaagccggcggcgugcuccgagccuaccaacugaccgcccccuucgaaacauucaagaaaaugggaaaacaaacaggcaucaucuacuacguaccggcagauuucacaucaaaaauaugccccgucaccggcuucguaaaccaacuauaccccaaauacgaauccguaucaaaaucacaggaauuuuucagcaaauucgacaaaaucugcuacaaccucgacaaaggcuacuucgaauuuucauucgacuacaaaaauuucggcgacaaagcagccaaaggcaaauggacaaucgcgagcuucggcuccagacuaaucaacuuccgcaacucagacaaaaaccacaacugggacacacgagaagucuaucccaccaaagaacucgaaaaacuccuuaaagacuacagcauagaauacggccacggcgaaugcauaaaagccgcaauauacgcagaaaacgacaagaaauucuucgccaaacucacauccauacugaacucgauccuccaaaugcgcaacagcaaaaccggaaccgaacucgacuaccucaucucccccgucgccgacgucaacggcaacuucuucgacucgcgacacgcccccaaaaacaugccacaagacgccgacgccaacggcgcguaccacauaggacucaaaggccucaugcuccuguacagaaucaaaaacaaccaagacggaaagaaacucaaccucguuaucaaaaaugaagaauacuucgaauuuguccaaaaccgcaacaaauccagcaaaaucuga

SEQ ID NO: 6945 - RNA, 3792 nt, Artificial Sequence
  Cpf1 variant
auggaggacuacuccggauucgucaacaucuacuccauacagaaaacacuacgguucgagcugaaaccagucggcaagacccucgagcauaucgagaagaaaggcuuccuaaagaaggauaaaauucgcgcagaggacuacaaagcggucaagaaaauaaucgauaaauaccaccgagcguauauagaagaagucuucgacagcgucuuacaucagaagaaaaagaaagacaaaacccgguucuccacacaauucauaaaagaaauaaaagaguucagcgaacuauacuacaaaacagagaaaaacauacccgacaaagaacgccucgaagcccuaucggaaaaauuacgaaaaaugcuagucggcgcguucaaaggagaguucagcgaagaagucgcagaaaaauacaagaaccuauucuccaaagaacuuauaaggaacgaaaucgaaaaguucugcgagaccgaugaggaacgaaaacaaguauccaacuucaagaguuucaccacguacuucaccggcuuccacagcaacagacaaaauauauacagcgacgagaagaaaagcaccgcgaucgguuaccgcauaauccaucaaaauuugccuaaguuccucgacaaccuaaaaauuauagaaagcauucaacgccgcuucaaggacuucccauggucagaccucaaaaagaaccuaaagaaaauagauaaaaacauaaaacucaccgaguacuucucgaucgacggcuucguuaacguccucaaccagaaggggauugacgccuacaacacuauccucggcggcaaauccgaggaauccggagagaaaauccaaggucuuaacgaauacauaaaucuguaccggcaaaagaacaauaucgacagaaagaaccuacccaacguaaagauucuguucaaacaaauacuuggggaccgggaaacaaaauccuucauccccgaagcauuccccgacgaccaguccgugcucaacagcaucacagaguucgccaaauaccuaaaacucgacaaaaagaaaaagagcaucaucgcagagcucaaaaaguuccuaucaucguuuaaccgcuacgaacuggacggcaucuauuuagcuaacgacaacucacucgcaucgauaagcacuuuccuguucgacgacuggagcuucaucaagaaauccguauccuucaaguacgacgaauccgucggcgaccccaagaagaaaaucaaaaguccccugaaauacgaaaaagaaaaagaaaaauggcucaaacagaaguauuacaccaucagcuuccugaacgacgccaucgaaucguacucaaaaagccaggaugaaaaacggguuaagauccgccucgaggcuuacuucgcagaguucaaauccaaggaugacgcuaagaaacaauucgaccuucucgaacggaucgaagaagccuacgccaucguagaaccccuacuuggagcggaauacccccgcgaccgcaacuuaaaagccgacaagaaagaaguggggaaaaucaaagacuuccucgacucgauuaagagccugcaauuuuuccuaaagccucuccucucagccgaaauauucgacgaaaaggaccucggcuucuacaaccaacuggagggguacuacgaggaaauagacuccauaggccaccuuuacaacaaggugcgaaacuaucuaaccggcaaaauuuacuccaaagaaaaauucaagcucaacuucgaaaacagcacccuccugaaaggaugggacgagaaccgcgaggucgcaaaccucugcgucaucuuccgggaggaccaaaaguacuaccuaggaguaauggacaaggagaacaacacaauucuaagcgacauacccaaggucaaacccaacgaacuauucuacgagaagaugguauacaaacuaauacccacaccccacaugcaacuaccuaggaucaucuucagcuccgacaaccugagcauauacaacccaagcaaaucaauucuaaagaucagggaagccaaaucauucaaagaaggcaaaaacuucaagcuaaaggauugccacaaauucaucgacuucuacaaagaaagcauuagcaaaaacgaggacuggucccgcuucgacuucaaauuuucaaaaaccagcucauaugagaacaucagcgaguucuacagagaagucgaacgccagggcuacaaccuggauuucaagaaagucagcaaauucuacaucgacucacucguagaagacggcaaacuauaccucuuucagauauauaacaaagacuucuccauauucagcaaagggaaaccaaaccuccacaccaucuacuuuaggucauuauucagcaaagaaaaccucaaggacgugugccuaaagcugaacggcgaagcggagauguucuuucgcaagaaaaguaucaauuacgacgagaaaaagaaacgcgaaggacaucaccccgaacucuucgaaaaacuuaaauaccccauacuaaaagacaaacgcuacagcgaggacaaauuccaauuccaccuaccgaucucccucaacuucaaaaguaaggagcgacuaaacuucaacuuaaaggucaaugaguuccuaaagcgcaacaaagacaucaauauuaucggaaucgaccggggcgaacggaaccuccucuaccuugucaugauaaaccagaaaggagaaauccucaaacagacccuccucgacagcaugcaaagcgguaaagggcgaccagaaaucaacuacaaggaaaagcugcaagaaaaagaaauugaacgggacaaagcuagaaagucuuggggcacuguugaaaacauaaaagaacucaaagaaggcuaucugagcauuguaauccaccaaaucagcaagcucaugguagaaaauaacgccaucguagugcuggaagaccucaacauaggguucaagagaggucgacaaaagguagaacgccaggucuaccagaaauucgagaaaaugcuaauugacaaacucaacuuccuggucuucaaagaaaacaaaccaaccgaaccaggagggguccugaaggcuuaccaacucacagacgaguuccagagcuucgaaaaacuaagcaaacaaacagguuuccuguucuacgugccguccuggaacaccagcaaaaucgacccacgcacaggauucaucgacuuccuacaccccgcauacgaaaacauagaaaaagccaaacaauggaucaauaaguucgacagcauccgcuucaacagcaagauggacugguucgaguucacggccgacaccagaaaauucucagaaaaucuaaugcuuggaaagaaccgggugugggugauuugcaccacgaacgucgaacgcuacuucacauccaaaacagccaacagcagcauccaauacaacaguauacaaauaacggaaaaacuaaaggaacuauucgucgacauacccuucucaaacggacaggaccucaaaccagaaauccuccguaaaaacgacgccguauucuuuaagucgcuccuguucuacauaaagaccacacuaucccugcgacaaaacaauggcaaaaagggagaggaggagaaggacuucauccucuccccugucgucgacagcaaggggcgguucuuuaacagccuagaggcuucggacgaugaacccaaggacgccgaugccaauggcgcuuaccacaucgcacuaaaaggccugaugaaccuauugguacucaacgagaccaaggaagaaaaccucagucgacccaaauggaagauaaagaacaaagacuggcuagaguucguaugggaacgaaaccgcuga

SEQ ID NO: 6946 - RNA, 2820 nt, Artificial Sequence
  Cpf1 variant
augaaccucuacucgaaccuaaccaacaaguacagccuauccaagacgcuacgcuuugaacugaucccccaaggcgaaacacuagaaaacaucaaggcccgaggccuaauccucgacgacgaaaaacgcgccaaagacuacaaaaaggcaaaacagaucaucgacaaauaccaccaguucuuuauagaggagauacucuccagugucugcauaucagaagaccuccuccagaacuacuccgacgucuacuucaaacuaaagaaaucggacgaugacaaccuccaaaaagacuucaaauccgccaaagacaccaucaaaaagcacauaagucgcuacauaaacgacuccgaaaaauucaaaaaucucuucaaucagaaccucaucgacgccaaaaagggucaagaaucagaccuaauucucuggcugaaacaaagcaaagacaaugggaucgaacuauucaaagcgaacuccgacauaaccgauauagacgaagccuuggagaucaucaaauccuucaaaggauggacaacuuacuucaaaggauuucacgaaaaccguaagaacgucuacucauccgacgacauccccaccuccaucaucuaccgcauugucgaugacaaccuacccaaguucauagaaaacaaagccaaauacgaaaaccuaaaggacaaggccccagaagccauaaacuaugagcaaaucaaaaaggaccuagccgaggagcuaaccuucgacauagacuacaaaaccucagaggucaaccaacgugucuucucccucgacgaagucuucgagauagcaaacuucaacaacuaccucaaucaauccggcauaacgaaauucaacaccaucauagggggaaaauucguaaacggugagaacaccaaacgaaaagguaucaacgaauacaucaaucuauauucccagcagaucaacgacaagacccuaaagaaauacaaaauguccguccucuucaaacaaauucuguccgacaccgagagcaaauccuucguaaucgacaagcuagaagacgacucugaugucguaacgacgaugcaauccuuuuaugaacaaauagcagccuuuaaaacacucgaagaaaaaucaaucaaagagacccuuucccuccucuucgacgaccucaaagcccaaaaacuugaccuaucuaaaauuuacuucaaaaacgacaaaucccuaaccgaccucucccaacaaguauucgaugacuacagugucauaggcaccgcaguccuggaauacaucacccaacaaguggcgccaaagaaccucgacaaccccagcaaaaaggagcaggaccucaucgccaaaaagacagaaaaagcaaaguaccucagccucgaaacgaucaaacucgcccucgaggaguucaacaaauaccgcgacauugacaaacaaugcagguucgaagaaaucuucgccucauucgccgacauaccgguacucuucgacgaaauagcacaaaacaaaaacaacuuagcacagauuagcauuaaguaccaaaaccaagggaagaaagaccuacuacaaacaagcgccgaagucgacguaaaagcgauuaaagaccuccucgaccagaccaacaaccuccuccacaaacucaaaauauuccacauaacccagagcgaagacaaagcaaauauccucgacaaagacgaacacuuuuaccuggucuucgacgaaugcuauuuugaacucgcaaacauugucgcccucuacaacaaaauccggaacuacaucacacaaaaaccuuacagcgacgaaaaauucaagcucaauuucgagaacucaacccucgccaacggcugggacaagaauaaagagcccgauaacacagcgauauuauucaucaaggacgacaaauacuaccucggcgugaugaacaaaaagaacaacaagaucuucgacgacaaagcgauaaaagaaaacaagggugaaggauacaagaaagucguauacaaacuacuccccggcgcgaacaaaaugcucccgaaggucuucuucucagccaaaucaauaaacuucuacaaucccucagaggacauacuacgcaucagaaaccacagcacccacacaaagaacggaagcccucagaaaggauacgaaaaacuggaguucaacauagaagacugcagaaaauucaucgauuucuacaagcacucgaucucccgccaucccgaauggaaagacuucggcuuccgauuuuccgacaccaagaaguacaacuccauagacgaauuuuaccgcgaggucgaaaaccaaggauacaagcugacauuugagaacauauccgaaagcuauaucgacucccucguagacgaggggaaauuauacuuauuccagauauacaacaaagacuuuagcgucuacucuaaaggcaagcccaaccuccauacacucuacuggaaagcccucuuugacgaacgcaaccuacaagacguagucuacaaacucaauggagaagcugaacucuucuacagaaaacaaagcauccccaagaaaaucacccauccagcaaaagaagccaucgccaacaaaaacaaagacaaccccaagaaagaaagcaucuucgaauacgaccucauaaaagacaaacgcuuuacagaggauaaauucuucuuccacugcccuauaacaaucaacuucaaauccucgggcgccaauaaauucaaugacgaaaucaacuuacuacuaaaagaaaaagcaaaugacgugcacauccuaucuaucgaccgcggcgaacgccaccuagccuauuacacccucguggacgggaaggguaacaucaucuguaagaacuga

SEQ ID NO: 6947 - RNA, 3795 nt, Artificial Sequence
  Cpf1 variant
augcuauuucaagaguucacccaccucuacccacuauccaaaaccguacgcuucgaacuaaaaccaaucggaaagacccuagaacacauacacgcgaaggacuuccuaucacaagacgaaaccauggcggacauguaccagaaagucaaagcuauccuagaugacuaccacagagacuucaucgccgacaugaugagcggaguuguacucaccaaacuagccgaguucuacgaaguguaccucgcgcuccgaaaaacgcccaaagacgauucccuacagaaacaacucacagaaauccaaacugcacuucggaaagagaucgugaaaccgaucgguuccggaggaaaauacaaagcaggguaugauagacuguucggcgcgaaacuuuucaaggacggaaaagaauuaggagaccucgcgaaguucgugaucacccaggaaggggaaucuucaccuaaacuagcccacaucgcccacuucgagaaguucucgacauacuucacaggcuuucacgacaacaggaagaacauguacuccgacgaagacaaacacaccgcaaucgcuuacagacuaauccacgaaaaccucccccgcuucaucgacaauuuacaaauccucgcgacaaucaaacaaaaacacuccgcccucuacgaccaaaucgucaacgaacugaacgccaacggccucgacgucucacuggccucgcacuuggacggauaccacaaauugcucacccaagaagggauaacggcauacaauacacuacucgggggaaucagcggagaagcaggcaguagaaagauacaagggauuaacgaacugaucaauauccaccacaaccaacacugccagaaaucagaaaggauugccaaacuaagaccccuccauaaacagauccuaagcgacggaaugggcguaucguuccucccuucuaaauucgcagacgacagugaggucugccaggccgucaaugaauuuuaccgccacuacgcgcaugucuucgccaaaguacaaucacucuucgaccgauucgacgacuauagaaaggacggcaucuacguggagcauaaaaacuuaaaugaacuaagcaagcaagcauucggagacuuugcgcucuugggacgcguacuagacggcuacuacgucgacgucgugaaccccgaguucaacgagcgcuucgcaaaagcuaaaacagacaaugcuaaagaaaaauugacaaaagagaaagacaaauuuaucaaaggcgugcacucccucgccagccuagagcaagccauagaacacuacaucgccggacacgacgacgaaucuguacaagccggcaaacuuggccaguauuucaaacacggccuagcaggcguagacaaccccauucaaaagauacacaacagccacucaacaaucaaaggcuuccucgaacgcgaacgcccggccggcgaacgggccuuaccaaaaauaaagucggauaaaucgccugagaugacccaacuuagacaacucaaagagcuacucgacaacgcccucaacguuguccauuucgcgaagcuccucacaaccaaaaccaccuuagacaaccaggacggcaacuucuacggagaauuuggggcacuauacgacgagcuugccaaaauagcgacccucuacaacaaaguucgagacuacuugagccaaaaaccuuuuucgacggagaaauacaaacuaaacuucggcaacccaacccuacuaaacggaugggaccucaacaaggaaaaagauaacuucggcgucauucugcaaaaagacggcugcuacuaccuugcccuccucgacaaggcacacaaaaaggucuucgacaacgcccccaacgcggggaaaucaguauaccagaaaaugguuuacaaacuacuucccggccccaauaagaugcuaccgaaggucuucuucgccaaaaguaaccucgacuauuacaaccccucagcagaacuacucgacaaguacgcgcaaggaacccacaagaaagggaacaacuucaaccucaaggacugccacgcccucauagacuucuucaaggccagcauaaacaaacauccagaguggcaacacuuuggcuucgaauuuucgccgacauccagcuaccaagaccuuagcgacuucuacagagaagucgaaccacaaggguaccaggugaaauucguugacauaaacgccgaauacauugacgagcuaguagaacaaggccaacuguaccucuuccaaaucuacaacaaagacuucagccccaaggcccacggaaaaccaaaccuccacacccucuacuucaaagcccuguucagugaaaacaaccuggcaaacccgauuuauaaauuaaacggggaagccgaaaucuucuaucgaaaagccucccucgacaugaaugaaaccacuauacaccgagcgggggagguucuggagaauaaaaacccagacaaccccaaaaagcgccaguucguauacgacauaauaaaggacaagcgcuacacccaggacaaauucaugcuccacguucccauaacaaugaacuucggcguccagggcaugacgaucaaagaguucaacaaaaagguaaaccaaucaauccaacaauacaacgacguuaacguaauagggauagaccggggcgaacgucaccuccuauaccuaaccguaaucaacuccaaaggcgaaauccucgaacagaggucguugaacgacauaauaacaacaucggccaacggaacacaaaugacgacccccuaucacaagauucuagacaagcgcgaaaucgaacgacuuaaugcgcgugucggguggggcgaaauagagaccaucaaagagcucaaguccgguuaccucagccacguaguccaccaaaucagucagcuaaugcuuaaguacaacgccauuguaguccuugaagaccuuaacuucggcuucaaacgaggccgguuuaaagucgagaagcaaaucuaccaaaacuucgaaaaugcccugauuaaaaagcucaaccaucuggcacucaaggacaaagcagacgacgagauaggcagcuauaaaaacgcccuucaacucaccaacaauuucacagaccucaaaagcauaggcaagcaaacaggauuccucuuuuacgucccggcauggaauacgucaaagaucgaccccgccacaggcuuuguagaccuccuaaaaccccguuaugaaaacaucgcacaaucgcaggcauucuucggcaaauucgacaaaauauucuacaacgcggacaaaggguacuucgaauuuuacguagauuacgcgaaauucacggacaaagccaaaaauucucgucagaccuggguaaucugcucccacggcgacaaacgauacguauacgacaaaaccgcgaaccaaaacaaaggugcaacaauaggcaucaacgucaaugacgaacugaagucccuauucgcccgcuaccacaucaacgacaaacaacccaaccuagucauggacaucugccagaacaacgacaaagaguuccacaagagccuaauguaccuccuaaaggcgcuccuagcgcuccguuauuccaacgccucauccgacgaggacuucauccucucaccgguagcggacgacaagggagucuucuucaauagcgcucucgccgacgacacccaaccccaaaacgcagaugccaacggcgcauaccacaucgcccucaaaggucuauggcuccucaacgaacucaagaacucgaacgaccucgacaaaaucaaacuagcaauagacaaccaaaccuggcucaacuucgcucaaaaucgauga

SEQ ID NO: 6948 - RNA, 3903 nt, Artificial Sequence
  Cpf1 variant
augagcauauaccaagaguucgucaacaaguauagccuaagcaaaacccugcgcuucgaacuuauuccccaagggaagacccucgaaaacauaaaagcaaggggccugauucucgacgacgaaaaacgcgcaaaagacuacaagaaagcaaaacaaaucauugauaaguaccaccaguucuucauugaagaaauucuuuccagcguaugcaucucagaggaccugcugcaaaacuacagcgacgucuacuucaaacucaagaaaagcgacgacgacaaccuacagaaggacuucaaauccgcgaaggauaccaucaaaaagcaaaucagcgaguacaucaaagauagcgagaaauucaaaaaccucuucaaccaaaaccuuauugacgccaagaagggccaagaaagugaccugauccuauggcucaagcaauccaaagacaacgggauagaacuauucaaagcaaacagcgacaucaccgacaucgacgaagcucuggagauaaucaaaucauucaaaggcuggaccaccuacuucaagggcuuccacgaaaacagaaagaacguauacuccucggacgacauuccaaccaguauaaucuaccgaaucgucgaugacaaccuaccaaaauuccuggaaaauaaagcgaaguacgaaucccuaaaggauaaggcacccgaagccauaaauuaugaacaaaucaaaaaggaccuggccgaagaguugacauucgacauagacuacaaaacaagcgaagucaaccagcgcguauucucccucgacgaagucuucgagaucgccaacuucaacaacuaccucaaccaauccggcauuaccaaauuuaauacaaucaucggcgguaaguucgugaacggcgaaaacacaaaacgcaagggaaucaaugaauauaucaauuuauacucacaacagauuaacgacaaaacucuaaagaaauacaagauguccguccuauucaaacaaauacuguccgacaccgaaucgaaauccuucguaaucgacaagcucgaagacgacagcgacgucgucaccacaaugcagucauucuacgagcaaaucgcagcauucaaaacgguagaggaaaagaguauuaaagaaacccucucgcuccucuuugacgaccucaaagcacagaaacucgaccucucaaagauauauuucaagaacgacaagucgcucaccgaccucagccagcaagucuucgacgacuacucagucauuggcaccgcaguccuagaguacauaacgcagcaggucgcuccgaaaaaccuggacaacccuagcaagaaggaacaagaccuaaucgccaaaaagacggaaaaagccaaauaccuaucccucgaaacuauaaagcuggcccuggaggaguucaacaaacaccgagacaucgacaaacaaugccgcuucgaagaaauccucgccaacuuugccgcaauccccaugaucuucgacgagaucgcacaaaacaaagacaaccuggcccagaucagccugaaauaccagaaccaggggaaaaaggaccuguugcaagccucggccgaggaggacgucaaagcuauaaaggaccuacuggaccaaaccaacaaccuccuccaccgacucaaaaucuuccacauuagccagagcgaggacaaggccaacauauuagacaaggacgagcacuucuaccucguauucgaagaaugcuacuucgaacuugcuaacaucgucccccuauacaauaaaauccgcaauuacaucacgcaaaagccauacucagacgaaaaauucaaacuuaacuuugagaacucaacucuagcgaacgguugggauaaaaacaaagaacccgacaacacggccauccuguuuauaaaggacgacaaguauuaccucggggugaugaacaagaaaaauaauaagaucuucgacgauaaggccauaaaagaaaacaaaggcgaaggauauaagaagaucguguacaaacuacuccccggugccaauaagaugcucccuaaagucuucuucucggcuaagucgauaaaguucuacaaccccuccgaagauauccuccggauaaggaaccacuccacacauaccaagaacggcaauccccaaaagggguacgagaaguucgaguuuaacaucgaggacugccgcaaauucaucgauuucuacaaggaaucgauuuccaagcacccggaauggaaggacuucggauuccgcuucuccgacacccaacgcuauaacucaaucgaugaguucuaccgugaaguagaaaaucaaggcuacaaguugacguucgaaaacaucagcgaauccuacaucgacagcguaguaaaccaaggaaaacucuaccuguuucaaaucuacaacaaggacuuuuccgcuuacucaaaaggcagaccaaaccuccacacgcuguacuggaaagcacucuucgacgaaagaaaccuacaggacgucgucuacaaacuuaacggugaagcggagcuauucuaccggaagcaaagcauccccaaaaagauaacacacccggccaaggaagcaaucgcgaauaaaaacaaagauaaccccaagaaagaaucuguauuugaauaugaucuuauuaaagacaaacguuuuaccgaagacaaauucuucuuccacugcccaauaaccauaaacuucaagucaagcggcgcaaacaaauucaacgacgaaaucaaccuacugcuaaaagaaaaggccaacgacguccacauccuauccauagaccgaggggaacggcaccuggccuacuacacucugguggacgguaaaggcaacauaaucaaacaagacaccuucaacaucauaggaaacgaccgcaugaagaccaacuaucacgacaaacuagccgccaucgaaaaagacagagauagugcccguaaagacuggaaaaagauaaacaacaucaaagaaaugaaagaaggauaucucucccaaguaguccacgagaucgcaaagcuagucauugaacacaacgcgauuguaguguucgaagaccuaaacuucggguuuaaacggggacgauucaaaguugagaaacagguauaccaaaaacuagagaaaaugcucauagaaaaacuuaacuaucuggucuuuaaagacaaugaguucgacaaaacaggaggcguucucagagcauaccaacugaccgcaccauucgaaacauucaagaaaauggguaagcaaacaggaaucauauacuacguccccgcagguuucaccucaaaaaucugccccguuacgggcuuugugaaccaacuauaccccaaauacgaaucagucagcaaaucccaagaguucuucucgaaguucgacaaaauaugcuacaaccuggacaagggauauuuugaguucucauuugauuacaaaaacuucggagacaaggcggcaaaaggcaaguggaccaucgcauccuuugguagcaggcucaucaacuuucguaacagcgauaagaaccauaacugggacacccgcgaaguauacccaacaaaagaacuggaaaagcucuugaaagacuacagcaucgaauacggccacggcgaaugcaucaaggccgcaaucuguggcgaaagcgacaagaaauucuucgcaaaacuaaccucgguccuaaacaccauccuacaaaugcgaaacagcaaaaccgggaccgaacuagacuaccucaucucaccaguagccgacgugaacggaaauuucuucgacagcagacaagcccccaaaaacaugccacaagacgcagacgcaaacggcgccuaccacauagggcucaaaggccugaugcugcuagaccgcauuaaaaacaaccaggaaggcaaaaagcugaaccuaguaauaaagaacgaagaauacuucgaguucguacaaaaccgaaacaacuga

SEQ ID NO: 6949 - RNA, 3756 nt, Artificial Sequence
  Cpf1 variant
augaaccacaugaaacaauucacgaaccaauuuucacuaucuaaaacgcuccguuuugaacuaauaccccaagguaaaacgaaagaauucauagaaaucaacgguuuaaucgagaaagacaaugagcgcgccguauccuacaagaaagucaaaaagaucaucgacgaauaccacaaauacuucauagaaaugguccuuugcgacuuuaaacuacacggccuugaaaccuaugagaccaucuucaacaaaaaagaaaaagacgacaccgacaaaaaagaguucgauaacauccgcaacucccuacggaagcagaucgccgaugccuucgccaaaaaccccaacgacgaaauuaaagaacgcuucaaaaaucucuuugccaaggagcuaauuaaacaagaccuauugaacuuuguugacgacgaacaaaaagaacuagucaacgaauuuaaagacuucacaaccuacuucaccggcuuccaccaaaaccgacgcaauauguacguagccgaugaaaaagccaccgcaauagcauaccgacucgucaacgaaaaccugccgaaauucaucgacaaccucaagaucuacgaaaagaucaaaaaggacgcccccgagcucauaucugaccucaauaagacgcucgucgagauggaagaaauagugcaaggcaaaacccuagacgaaauauuuagccucucguucuucaaucaaaccuugacacaaacaggcauagaacucuacaauaucgucauaggcggccggacagcugacgaaggcaagacaaaaauuaagggccucaacgaguauauaaacacggacuacaaccagaaacaaaccgacaagaaaaaaaagcaggcgaaauucaaacagcuauacaagcagauacucuccgaccgccacagcgugagcuuuguagcggaaaccuucgaaaccgacgcccaacuccuagaaaacaucgagcaguucuacucuagcguccuaugcaacuacgaagaugacggucacacgaccaacaucuucgaagccaucaagaaucucaucauaggacucaaaacuuucgaucucucgaagaucuaccugagaaacgacacgucgcuaaccgacaucucgcaaaagcuauucggugacuggucgaucauaagcuccgcccugaacgacuauuaugaaaaacaaaauccgaucucgucuaaggaaaaacaagaaaaauacgacgaacgcaaagccaaauggcuaaagcaggauuucaacaucgaaaccauucaaacggcacuaaacgaaugcgacucagaaauaauaaaggaaaaaaacaacaaaaauaucgucucagaauacuucgcaaaacuuggccucgacaaagacaacaagaucgaccucuuacagaaaauacaccauaacuacgucgucaucaaggaccuccucaacgagccauacccggaaaacaucaagcucggcaaccaaaaagagcaagugagccagaucaaagacuuucucgacuccauucugaaccucauccacuuccugaaaccgcuaagccucaaagacaaagacaaagaaaaagacgagcucuucuacucgcuauucacagcccucuucgagcaccugucgcaaacaaucagcaucuacaauaaaguucgaaacuaucuaacacagaaggcauacuccacagagaaaaucaaacuaaacuucgaaaacagcacucuccugaacgggugggacguaaauaaggaaccagugaacacaagcguaaucuucagaaaaaacggacuuuucuaccucggaaucaugucaaaaucuaacaaccgaauauucgaacgcaacgucccggucugcaaaaacgaggaaaccgccuucgaaaagaugaacuacaaacuacuacccggcgcaaacaaaaugcuccccaagguuuuccugagcgccaagggaaucgaauccuuccagccaucagcagaaauucagagcaaauaccaaaaggagacccauaaaaagggcgacgccuucgugcgcaaagacauggaaaacuuaauagacuucuucaaacagagcauagccaaacacacagacuggaaacacuucaaccaccaauucagcaaaacggaaacauacaacgaccucucagaguucuacaaggagguggagaaacaaggguacaagcuaacguucaccaagcucgacgaaacguacaucaaccagcucgucgacgagggcaaacuauacuuauuccagauauacaacaaagacuucagccccuucucgaaaggaaaaccuaacaugcauacgcuguacuggaagaugcucuucgacgaacaaaaccuucaaaacgucguuuacaaguugaacggggaggcagagguauucuucagacaauccucgauaaaacagaccgaucgcauaauccacaaggcgaaucaagcuauagacaacaagaacccccucaacaacaagaaacaaucgagcuuuaacuacgaccucaucaaggacaaacgguucacccucgacaaguuucaguuccacgucccaaucacucuaaacuuuaaggccgaaggaaacgaguaccugaacacuaaaguaaacgaauaccucaaguccaauuccgacguaaaaaucauugggcucgaccgaggcgaacgccaucugauauaccugacucucauaaaucaaaaaggcgaacuacucaaacaacaaucacuuaacgucauagccacaagccaagagcacgaaaccgacuacaaaaaccuacucgucaauaaagaaaacgaacgcgcuaacgcaaggcaggacuggaaaaccaucgaaacgaucaaagagcuuaaagaaggauaccucucacaggucguucaucaaaucgcuaccaugauggucgacgaaaacgccauagucgugauggaagaccuaaacgccggauucaugcgaggacgacaaaagguggaacggcagguguaucagaaacuagaaaaaaugcuuauagagaaacucaacuacuuggucuucaaaaacaacgacguaaaugaaaccgcagggguacuaaacgcacugcagcucaccaacaaguucgaaagcuucgaaaaaauggguaaacaaagcgguuuccuguucuacguuccggcauggaauacuucgaagaucgaccccgcaacugguuucguagacuuccugaaacccaaguacgaaucgguggaaaaagccaagcucuucuucgagaaauucgaaagcauaaaauuuaacgccgacaaaaacuacuucgaauucgaauuugacuacaagaaauuuaccgaaaaagccgaaggcucccaaacaaaguggacagucugcacacauuccgacguacgauacagauacaacccccaaacaaaggccuccgacgaagucaacguuacaaacgaacucaaauugauauucgacaaauucaaaaucgaguauaaaaacggcaaaaaccuaaagaccgaacugcugcuccaggacgacaagcagcucuucagcaaacuccuacauuaccucgcccucacacugaugcuccgacaguccaaaucaggaacggacaucgacuucauacucaguccgguggcaaaaaacggcguguucuaugacagcaggaacgcuaugccaaaccuccccaaagacgcugacgccaacggggcauuucacaucgcccuaaaggggcuauggugcguccaacaaauuaaaaaggcugacgaccuaaagaaaaucaagcuggccaucucgaauaaagaauggcucaguuucguacagaaccucaaguga

SEQ ID NO: 6950 - RNA, 4173 nt, Artificial Sequence
  Cpf1 variant
augaucgacaacacaaaggaaaagaaagaaggaucaguauucgacggcuucacgaggaaauaccaacucuccaaaacacuccgauuugagcuacguccaauccucaacacccccaaaaugcuugacgacgaacaggucauaaaaaacgacgaaacuagacgaaaaaaguacgaagccgucaaaccaugguuugaccaacuacaccgcgaguucaucgaggaugcacuaaagucguucaaauucaaaaaccucgccauauaccaggacacauuucagacauggcaaaaggacagaaagucaaagcagaaaaaagacacauuagugaagauagaaguaggacuacgggaagaaauaguaaggagguucgaggaggucgccaacauuuggguaagaucagagcaauacaaacuccucggcauaaaaaaagaaggccucggcaugcuguucgaagcgggggucuuucgccugcuaaaggaaagauucaaaaacgagaaagacaccaccgucgauggaaacaacaucuucgacgaguggacccgauggacuggcuacuucaaaaaauuuuuugagacacgcaaaaacuucuacaagucggacgacacaagcaccgcaaucgcauaccgcgugauaaaccagaaccuacggcgguuuugugagaacauccaaauauucgaaaagaucucggagaaaauagaauucagcgaaguggaaaaaucguucgacaucagcugcgcggguaucuuuucacuugcauacuacaacgcgugccugcuacagggugggaucgacacauacaacaaaauaaucgggggcgaaguugacgagaaggacaaaaaaauucccggaaucaacgagcuaauaaacaaauacaggcaagacaacucgggggagaaaaucccguuccugaagcaacuagauaagcaaauacacuccgcuaaagaagcguucaucgagucaauagaaacaaacaaggaacuuguugggaagcugaaaacauucuacgagaacgcugaggucaaaauccaauccuucaggaaccucauugcagacaucgucaccgacuacagcggcuaugauauugacaagaucuaccugaccaaagaagcaguaucacauaacgccucacgaugguucgcgucuuucgaaagcuuugaaagagacuuauucgcgguaguagccgagaaacaaaacaaacucguuuacgaauuacuccgaacccacaaaaacgacagcaagaucagcgacaaggacgggaaguucagcuuccccgacuucaucaaaugcucacacaucaagagagcccucgaaaagcaggaagggcggauauggaaaggggaguacuacgaagacauagucgacuuugagaaaauaaaagacgucuucacgcaguuucuaugcgucuucaaguuugaacucgaacaacaauucuuucgcaagacaacaucagcccaaaccggcgaacagaccaagauaggcuacgaaauuuucgucacaaaaauaaacgagcucaucacccgcgaaaacccugucauagaccucgaagagaagauagcgaucaagaacuuugcggacgcaacccuccucaucuaccaaauagccaaauauuuugccguagagaaacggcgcggauggcucgacaauuacgaccucgaugacagauucuauaagucauccgacaucggcuaccuaaacuucuaccgggacgcguucgaacaaauaguccgccccuacaaccuauuccgaaacuaccugaccaagaaaccguacaacacaaacaaauggguacuauccuucgaaaauccuacccucgcagacggcugggauaaaaacaaagagaaaaccaacgcugccgugauacuccggaaagacgggcgcuacuaccugggaauuaucaaggaagacuguaaaucccuguucgcggaccgauacagcaaggaaaugagcgaaggaaucgaauccgggagcuuccaaaagauggcguacaaguucuuccccgaagcaagcaaaaugauccccaaauguagcacgcagacaaaaaacgugaaagaacacuuucgaaagagcucauccgacuauaaccuguuccacgaaaaggacuacaaaauuuccgucgccaucacaaaaaacauauacgaacuaaacaacguauucuaccgaaaagacaacauagaagagagcuucguaccgaagaacgacuucgaaaaaaagcugggaguaaagaaauuccaacgccaauaucuagagauuagcagggacaacaacggauacaagcaggcccucgcacaauggauugaauucugcauccgguuccuaaaagccuacaaaucaacgaccauauucgauuacagccgccuccgagaggccaaagaguacgagagccuggacgccuucuaccaggacaucaacgcccucacauacaauauaagcuucguacccaucuccgaacaguacauaaaagagaaaaacgacaauggggagcuguuccucuucgagaucuacaacaaagacuggucccugggccccauggacaaaaaccgcaagcgcacuaaaaaccuucacacucucuacuucgagcagcuguucucgaaagaaaacgaacaggagaacuuccuauuccaacugaacggagaagcagaacuguucuuccguccaaagacagaagaaaaacgacuaggguauaaagucugggacgccggcgagaaaaagugggucaaggcgaaggagaaggaagacggugcagugaucgacaggaaacgauacgccaaagacaucauccucuuccacugccccauaacacuuaaccgcgugagcgaaagcaagaccaaacgggaaauggacgucgaaauccgagaaguccuaagcagcacgcccggaguacacauuaucggggucgaccgaggagagaaacaccucgccuacuauagcgucauagaccaaaauggcaaaaucaucgaaaccgacacgcuaaacucgaucggcaaagacggacggggcaaaccuguagaauaugccagcaaacuggagaaaagagcacaagagcgcgaggcgucccggagagacugggaagaggucgaagcaauaaaggacuugaagaagggauacaucucccaaguaauaagaaaccuggccgaccugauaaucaaacacaacgccaucaucguuuucgaggaucugaacaugcgguucaagcagauaagggggggaaucgaaaaaagugcguaccagcagcuggaaagggcgcuaaucgacaaacugucguuccuggucaaaaagggagaggaggacccaaaacaaaccggccacauccuucgggccuaccaacucgcagccccggucauagccuucaaagacaugggaaagcaaacaggucuuaucuucuacacgcaagccggcuacacaagcaagaccugcccagaaugcggcuaccggagaaauaucaaaugccucuuugaaaacauagaacaggccaagacgcucaucgaaaaccuagaauccaucaacuacaacaagaaggaagacguauuccagauauccuacagccuugagaagcugucguccaaagaccaaaagaaggagaagaaaguauccaacgaacuauacgccaaaacgcucaaaaaagacauauucauauugacgacaaaaaaugcgcuacgcuacaagugguacgaccgcuacagcgagaaggcaaaggucgcaaaacgaggaauagacgaauacaagggagaagugaaugaaucagagaccaaaaaaggcgucgugaaagaauucaaccugacggaguaccugaaaggccuacuaaaaaccuacgaaaucgacuaugaacauggagguauccgagaacaaauacugucagucgcccgagggcgagaguucuacaaggacuuccuauacgcccuguuccugcuaaccgagacacgacacuccauaagcgggcgcaauacagacuacauacaauguccagaaugcgaauucgacagcaggaaaggauucaaagacauaaaagaguucaacggggacgccaacggagcauacaauauagcccguaaaggaaucaugauccuagagaagauaaaacaauuuaaaaaagacaacgacgguaaccucgagaaaaugggcuggggggaccuaagcauauccaucgaagaaugggauaaguucacucaaaaagaauga

SEQ ID NO: 6951 - RNA, 4026 nt, Artificial Sequence
  Cpf1 variant
augaacgcggaaaaaaaaugcgccuucaacgaauucacaaaccucuacgaacuaucaaagacccucaaauucgaauugaagccagugggcaaaacaaaagaaaucaucaagaacuuccgggaggaacucgaaaagaacaaccccauccagcucgacaaggagauuagcaucgccaagcaagaaauaaagaaggaccucgacauacuacacagagaguucguacgccagucguuugagcucgccuucaaagaaaauaagaucaauuacgaaauauucuucgaaaucuaccguaacuucaaaaaauucucgaagaacaagaagucagacgaauacaucgcggcaauuaaaaaccucaaagaggaaaaaauaaaguuagucaaaaaaaucgcggacuacuucguuaaaauggaccaagaauggcguaaguacuaucccagcgaaaagaaaagcuuccuccucaugaguaacggcgucaucaaccuacuaaucgacaucaacaaagaccgcauggacuacagcuucauacccaaagaggugugcgagaagauaaaaggaaaagggaaaaucgaacuauacgaaaaauucaacaagcacuucgguuaccuuuccaaguauaacaccgcucgcgaaaacuucuacagugacgacgucaagaacagcgcgagcguagccuaccgugccauaugcgaaaaccuugagaaguucugcgacaacaaaauaaaaguagaggcagacaauuucccgaaagaaaucaaagagaaauuccucgaauacuucaacaaaaucaccgaccucagcuucuacaaccgcugccuuagccaaaacggaaucgaggaauaucauaaauucaaggacgaaaucaaccgcagcaucaaugaacuauaccccaacaacagcaaaaacaaaccccaaaacauacccuaucuaaguaagcuggauaaacagauccucucagaaaaagacaaacagagcuggauugaagaaggauucauagacgaaaacaacuuuaucuucgaauucgaaaaauuuauaaaaaugaacgacaaguacauucccagcgaaaagaaauuauucaacgaauucuucauauuccagaauaacgacgagguucuacagaaacuauuccuacuuaaaaagacgaucaacaacuucgcaaacauuuaccucgacgacccgaaaaaccuuauggaucucaugccgagcaagggaaccaaaaaaagggacuacuuaucacuacuagaaauuaaggaggcacugaacucauaugcagaaaaccagaacauuggcgaaacccaaaucuucaagaucaaauacgacgacgucauagauaaaaccaagacgcccuuugagugcuucaugaagauuuggaaguaugaauacgaccuccucuacaacgagggagacgggaaaaaaaacaucgaagaggggugggagaagaucugcgaaaaacuacaaaacaaaaaggacgaauuuaccggggauuacggaaaguacaagaaagaaaucaaggacuacugugagauggcacugagccuaucacaacgcaucaagcacuuagauauccgcaucaaaaaaagggacggaagcgaggaugccgacaacaaccucuucgaaggcguagagaaacuggacgaauucuacgacagauuauucgaaauuguagaugaacacaacgcguaccaguaccaccacgaguuucaagcguuccuaacaaaaaaaccauacaagacagacaaguucaaacucagcuucgacaauccacaacugcucaagggcugggaccuaaacaaggaacccgacuacuucggcgcacugcuaguuaaaaacgagaaauacuucuuagccguauuccacaagcaguacgccaacgaaauauuccgacagaaaaacaagaauucaaccgugaagaucaaggaggccuacgacgucuucaacggaaacuauuacaaaaagguagaacuaaagcaaauacccaaacuguucaugaaccuucccaggaucugcuucgccaaaucaaaccaagaggaguucggcuuaacuauugagcuagagaaaaucaaaagcgaauuugacaaguuucaaaaacuuaaaaaggaacgccaagacaacaaucucaaauucgaucaagaaaaauucaucaagcugcuggccuauuaccgacacugccuggagauacgcgaggauuggaaagucuucaaauacaacuucaagccacuuuacaaauacucaaacuuaggugaguuuuacagggaucuggagaaggauacauacaauuuggaccugguccgugucaacagcgaguacguagaaaagaaaagaaaugaaggcaaacuguacuuguuugaagucuacaauaaagauuucucggacaagucaaucggccgaaagaacauccacagcgacuacuuuaaaagucuguuccuccccgacaaccugacgaacaaaaagaucgccuuagcggcagacgcugagaucuucuuccgcgagaagagccucaagaacaaagacgaaaucauaacgcaaaagaacaaaaucaaaauagacaagaacaaccacaaaggagaaaaagcauauagcaaaaacagguauacggacgauaaaaucauccuacaccucccaaucaaccuaaacuucggcgaaaacaaaaaccauaaagacuucaacuaugagaucaaugacucccugcuaaagaacaaccgcgacaucaaaauaauaggcaucgacagaggugaaaaauaccugcucuacuacagcgucaucgaccaaaagggcgacaucaaggaaaugggggacuucaacgucgugaacgggguggacuacuauagcaaacuaguggcguacgaggagaagcgaaaacaggcacgccuugacuggggggauauacaguccauaaaagaacuuaaggaaggcuauauuagccacgucauacaugaaauaugcgaccuaaucaagaaauacaaugccaucgugguacuagaggaccucagcaugggcuucaaaaggggccgcuucuuccgagaaagacaggucuaccaaaaauucgagcucgcgcuauuccgcaaauuaaacuacuggguagacaaaaacaaggaagagggggagaaagggucugcccugagcgccuggcagcucaccccaaacgaaaaagacuucaaaguaucccaacuggaaaaagcacggcaacugggcauacuguucuacaccgcagcuggcuauaccucgaagaccugcccggacugcggauuuaggaaaaauauaacccuaaaguacgugaaugacaagcagcuaaaagaggaccugggcaaacucaagaucaacuucgucgaagaccacuucaagaucaaguacaaccuauuggacuucgagaaaaacaaaaaaagcgaaaaggcgaaagacacgguacugccuaaagaagaacgcaagaucagcuucguggccaacuccaaagucauccgaaucagauggcacgauaucaaaacgaaacuggcaaagcgugaacuagacggcgaaaagaucaucaagaaguucccaaaaggcgucauaaaagaguacgacauuaacauaugccuaaagcgaauaaucggagacaaaaucgacuuuagcaaagauuccauuaccgaacagcuuauaaacggccgguucggcaaagacuucuacugggaacugauguacuuucugaauuugauccuagagauccgcaacguaguaucagagacagaaaucgacuacauccaaugccccgucugcggauuccacagugaugacggcuuccgaggaaauaaauucaacggggacgcaaacggcgccuacaacauugcacgaaaaggcaggcucauccucgaaaaaauuaaccagcacaaaaaccucaaggaauuaaagacuggcgaccucagcgucaacaucgucgagugggacaaggcuguaaacaacugggacaaauucgugcaaggcgacaacacagaaagcaaaaacauagaaaucccagcgaaggaagagaugaucuccguggagguccgggaaagcuga

SEQ ID NO: 6952 - RNA, 4107 nt, Artificial Sequence
  Cpf1 variant
augaagaaagaaaaagaguuuaagagcuucggagacuucaccaaccuguacgaaauaaguaaaacacuacgguucgaacuaaaaccgguagagaauacacaaaccaugcucgaugaagcagacgucuucggaaaagacaaagucaucaaagacaaguacacaaaaacgaaaccguucaucgauaaacuacacagggaguucgucgacgaaagccucaaggacgucagccuaucuggacugaaaaaguacagcgaaguccucgaaaacuggaagaaaaacaaaaaggacaaagacaucguaaaagaacucaagaaagaagaagaaagguugcggaaagaaguuguugaguucuucgauaacaccgcaaagaaaugggccaacgaaaaauacaaagagcucggacugaagaagaaagacaucgguauacucuucgaagaaaguguuuucgaccugcugaaagaaaaauacggcgaggagcaagacagcuuucucaaagaggaaaagggcgauuuccucaagaaugaaaaaggggagaagguauccaucuucgacgaauggaaaggguucguaggcuacuucacaaaguuccaagaaacacgaaagaauuuuuauaagaacgacggcacagaaaccgcccuugcgacacgaaucauagaccaaaaccucaagagauucugcgauaacaucgacgacuucaaaaagaucaaaaacaagaucgacuucagcgaaguagagaagaacuucaacaaaacagccgauguguucucccucgauuucuacaaccaaugcuugcuccagaaaggcaucgacagcuauaacgaguucauaggagggaagacccuagaaaacggaaagaaacuaaaaggcguaaacgaacugguuaacgaguaccgccagaaaaacaaaaacgaaaaagucagcuuccuaaagcuccuagacaagcaaauccucuccgagaaagaaaaacucucuuucggcauagaaaacgacgaacaacuucucguaguacuaaacagcuucuacgagacagcggaagagaaaaccaagauacuacgcacccucuucggagacuuuguggagcacaacgagaacuacgaucucgacaaaacauauaucagcaaaguagcauucaacacaauaucucacaaguggacgaacgagacacacaaauucgaggaacuacucuacggggcaaugaaagaggauaaaccgauuggccucaacuacgauaaaaaggaagacucauacaaauucccagacuuuaucgcccuaggcuaccucaagaaaugucucaacaaccuggacugcgauaccaaauucuggaaagaaaaguacuaugaaaacaacgccgacaaaaaggacaaagacaaaggauuccucaccgguggacaaaacgcaugggaccaguuccugcaaauauucaucuuugaauuuaaccaacuguucaacucggaggccuuugauaacaaagguaaagaaaucaaaaucgguuacgauaauuuuagaaaggacuucgaggaaauuaucaaucagaaggacuuuaaaaaugacgagaaccugaaaaucgcaaucaaaaacuucgcagacucgguccuauggaucuaccagauggccaaauacuucgcaaucgaaaagaaacgcgggugggacgacgacuucgagcuguccgaauuuuacaccaacccguccaacggguacagccuuuucuacgaucgagcguacgaggagauuguucaaaaauauaacgaccugcgaaacuaccuaacgaagaaacccuacaaggaagacaaauggaaacucaacuucgaaaacccaacgcuggcaaacggauuugacaagaacaaagaaucagacaacagcacugucauccuacguaaaaagcgcaaauacuacuuagggcucaugaagaaaggcaauaacaaaauuuucgaagaucggaacaaagcagaguucauacgcaauaucgaaagcggugcauacgaaaagauggcauacaaguaccugccagacguagcuaaaaugaucccaaagugcuccacgcagcugaacgaggcuaagaaucacuuucguaacucggccgacgaccucgaaauaaagaaaucuuucucgaacccccuaaaaaucacgaaacgaauauucgaucucaacaacauacaguacgacaaaaccaacguaucgaagaaaaucagcggagacaacaaaggcaucaaaaucuuccagaaagaauacuacaaaaucuccggugacuucgacguguauaaaagcgcgcucaacgauuggaucgauuucugcaaagacuuccugagcaaauacgacucgaccaaagacuucgacuucucgauccugcgcaagaccaaagacuacaagucccuagacgaguucuacgucgacgucgcgaagaucaccuauaagaucagcuucacgccugugagcgaaucuuacaucgaucagaagaacaagaacggagaacuguaucuuuucgaaauuuacaaccaagacuucgccaagggcaagaugggagcuaagaaccuacacacacuauacuucgaaaauguauucucccccgaaaacauuagcaaaaacuucccaaucaagcugaacggcaacgccgaacucuucuuccgacccaagagcauagaaagcaaaaaggagaaacgaaacuucgugagggagaucguaaacaagaaacgcuacagcgaagacaaaauauucuuucacugcccgauuacccucaaccgggagaccgguagcaucuaccgcuuuaauaacuacgucaacaacuuccuaucagaaaacaacaucaacauaauaggagucgauagaggggagaaacaccucgccuacuacucaguaauagacaaaaacggcguaaaaauaggaggaggcagcuucaacgagauuaacaaggucgacuacgccaagaaacuggaagaacgggcaggagagcgggagcagucacgcaaggauuggcagguaguagaagggaucaaagaccucaaaaaggguuacaucucgcaagucguccgggaacuagcggaccuagccaucaaacacaacgcgaucauaguccuagaagaccuaaacaugcgguucaaacaaaucagagggggaaucgagaaaagcaucuaccaacaacuagaaaaagcgcuaaucgacaagcugagcuuccucguggagaagggcgaaaaagacccgaaccaggccggccacauacuaaaggcauaccaacuagcggcgcccuucaccucuuucaaagacaugggcaaacaaaccgguaucgucuucuacacgcaagcgagcuauaccagcaaaaccuguccaaacugcggcuuccggaagaacaauaauaaauucuacuucgaaaacaacaucgggaaggcccaggacgcccucaagaaacuuaaaacuuucgaauacgacucagaaaauaaaugcuucggucuaaguuacugccucagcgacuucgccaacaaggaggaggucgagaaaaauaagaauaagaaaaggaacaacgcgccguauucagacauugagaagaaagacugcuucgaacucagcacaaaagaugccguacgauaccgauggcacgacaaaaacaccgaacgaggaaaaacauuuuucgaaggcgaaucagucuaugaagaaaaggaggaaaaagaaauaggccagacgaagaggggccucgucaaagaauacgacauuaguaaaugccucauaggacucuucgaaaagacgggacuagacuacaagcaaaaccuccucgauaagaucaacuccggcaaauucgacggcacauuuuacaaaaaccuauucaacuaucuuaacuuacuguucgagaucagaaacuccaucagcggaaccgaaaucgacuacaucucaugcccagagugccaauuccacacagauaaaagcaagaccauuaaaaacggagacgacaacggguccuacaacauagcgaggaaaggcaugauaauacuugacaaaauaaaacaguucaaaaaggagaacggaagccucgacaagaugggguggggagaacucuuuaucgaccuggaagaaugggacaaauucgcucagaaaaagaacaauaacauaauugauaaauga

SEQ ID NO: 6953 - RNA, 4149 nt, Artificial Sequence
  Cpf1 variant
auguccaaaaauaacguaugggacaaauucaccaaccaguacucgcugaguaagacccuccgguucgaacuaaagcccgugggcaagacgagggaaaagaugaacgaacaguuaaaguacgacaagcaauuacaaacguuccuaaaggaccaagaaaucgaggacgcauaucaauaccuaaagccauucuuugacaaacuccacaaagaguucaucaccgauucccuagacuccgauaccacgaagaaaauugacuucagcgacuaccucaucgacuaccgugacaaaaaggaccucaccaagaaagaagacagccugagaaagaacauaggcgagguguucgucaaagccggugaccgguggaagaaagagaaauaccccaaauacgaguggaaaaaggguaguaauguggcgaacggauccggaauccuacucacacaggacguacugaugcugauaaaagaccucaaccccaacgaccagaaaauaaagaaaaugauagaagaaacguucaaaggauucuucacguacuucuccggcuuuaaccuaaaccgggaaaacuacuauaccaccaaaguagagaaagccaccgccgucgccacuagaaucgugcacgacaaccucccgaaguucugcgacaaccucguccaauucgagugcaucauaaagaagaagaaaaacggcgagguagaccgcaucgagcgaaaaucggaauaccucaacgcguaucaauaccucaaaucaaaagggcgcaccacacaaaucaaagaugcagaaucagggaaaaugaucgaggccgaagucaucaaugaaaacauguucuccaucagcuacuucuccgccugcuugucccaauccggcauagaggaguacaauaggacuauuggacacuacaacuugcucauaaaccucuacaaccaagcgaaagagggcgaggaaaaagaccugaagaaauccgagaaaaaguuuaaacggcugcccaucuucaagacacuuuacaaacagaucggcugcggcgaaaaagaacccuuauucuucagccuaacacacgacacaaaauugcaaguacaagagaacaaagagaacuacaagaaaccauacagcguagagcaaauccucgagcaagccaaacuggcaggagacaaauacuucaagggcaaauccaacgauggcauauuaaacacgauaccagaguucuccgacuacauauuacaaaaagagaguuacggaggugucuacugguccaagguagcgaucaacaccaucucaaaccgcuacuucgagaacuggcacacacucaaggacgcccuaaucgacgcgaaagucuucgaaaaggggaagaaaggugacgaggaggacgugaaaauaccagagagcaucgaacugcaaggcuucuucgacguacuagacacccaagaaggguggaaaagcgaaggaauauucuucaagaaaagccugaccgaggaacuaaagaacaaggaagcggacaccaaaaacaagaaacggcgagagaucguaaaggaagcgaaaagaccgucccaggcucuacuugcccuacuguucgacgacauacaggagcaugcgaaccuauuccucaaccagucagacgaaauauuaaaacuggagaaauacucagagaaagaauccaaagagaaaaucaagcaauggauggacuccgcgcucgccgucaaucgaauacuaaaguacuucuucguuaaggaaucaaaggcaaaaggcgaacagaucgaccccaucauuagugaagccuuaaaaguacucuucaacuccgaggacgccacaugguucaaaugguacgacgcccuccggaacuaccucacaaagaaaccccaagacgacgucaaggaaaacaaguuaaaacucaacuucgaaaacagcaccuuagccggcgggugggacauaaacaaagaauccgacaacuacugcgucauacuacaagaccaaaagggcaagcagcaccucggcauaauugccaagaaggagaagcaacgcggcuacaacaaaaucuucgagcgaacgcccgaaaauccccuauauaaaauagacuccggcgagguguggcagaaaauggaauacaaacaaaucgccgugcccaccggaauaggaggguucguaagaaaauguuucaacaccgcccaacaauacggguggaaaugcccggacaacugucuaaacagcgaaggaaaaauaaucaucaaaaacgacgaggcaaaagaaaacuuagaagcaaucauagacugcuauaaagacuucuuuacaaaguacgagaaagacggauucaaguacaaaaacuucaacuucaacuucaaagaaucugaagaguacgaggagcugaacucauucuucuccgacguggaaagacagggauacaagcuaggauucauaacggucaacaaaacaaucauagacaagugggucgaagacggcacgaucuaccuauucgaaaucaaaaaccaagauaccaacgacggaaagaaagaugggcacaaaaacaaccuucacaccaucuacuggaaagcccucuucgaagacguagggaacaaacccaaacucaacggaggagcagaacuauuuuaccguaaggcccuacugaaggacaaacaagagaagauugaagacaacuacgggaaggaaaucaucaaaaacuucagguucucaaaagagaaguuucuguuccacugcccgauaaaacuaaacuauaaagcaaaaucguauucgcacccgaaauacgcacugcccgagaucaacaaacagacaaacgaguucuuuauuaccaucucggacaucugcuuccugggaaucgauagaggggaaaagcaccuagccuacuacucccugguaaaccagaaagaggaaaucauagaucaaggcacccucaacaugccauucgucgacaaagacggcaaaccgcggagcaucaagaaggaaaaauucagguucgacgcgaagguggacaaaugggucucggaggaaauggacugcuggaacuacaaugaucuccucgacgccauggcgucaaacagggacauggcgcggaaaaacuggcaaaccaucgguaccaucaaagaacuuaaaaacggcuacaucucacaagucgugcgcaaaauagucgaucucgcgaucgacaaaaaccggggaauacccagcuucaucguacuggagaaucucaacgcaggauucaugcgaggccgacagaaaaucgagaaaagcguuuaccaaaagcuagaacucgcacuagccaaaaagcucaacuucguagucgauaaaacgguccaaaacggggaaauagggucagucaccaacgcacugcaacucacaccgcccguaacaaacuuccaaaauaucgaaaaucgcaagcaagugggaauaaugcuguacacccgagcagacuacacaagccaaacagaccccgucacgggcuggcgcaaaagcauuuaccuaaagaaaggaagcgaagaauauaucaaaucccagauaauggauuccuucgaugacuucgguuucgaugggaagaacuacuacuuuaaauacacggucgacuuaauagacccaauaaagaaaacaagcgagaagaaauucaagaaacaguggacacuauauagcggcauuaacggcaaaucgcuggacagguucagaggagaacgcuccucagacaaaaacgucuggaucaaaacccuccaagacaucaaaaccacccuagacgccguguucauaggguucgaccugcagcacucucuuagaagccaaaucaucaacgacggaauuaugcccaagaaaauagagaacucucaguucaccggcugggaaagccuuagguucgccaucgagaugauccagcaaauacggaacauaggcguggaaaagggagacgaagacuuuauacuaucgccaguacgagacaagaacgaaaaccacuucgacagccgaaaggccaaggaaaacgagcccaacagcggcgacgccaacggcgcguacaauaucgcaaggaaaggcaucauuaugaaugagcauaucaagaaggaccuaauccccuucauacaagacaaggaaugggacgccuggcucgcaggacgcgaagucugggacaaauggcuuauagaaaacaaagacucccuaaucuacaaaaaguga

SEQ ID NO: 6954 - RNA, 4203 nt, Artificial Sequence
  Cas9 variant mRNA product
auggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauga

SEQ ID NO: 6955 - RNA, 4986 nt, Artificial Sequence
  Cas9 variant mRNA product
auggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauga

SEQ ID NO: 6956 - RNA, 3258 nt, Artificial Sequence
  Cas9 variant mRNA product
auggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauga

SEQ ID NO: 6957 - RNA, 4326 nt, Artificial Sequence
  Cas9 variant mRNA product
auggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauga

SEQ ID NO: 6958 - RNA, 3402 nt, Artificial Sequence
  Cas9 variant mRNA product
auggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauga

SEQ ID NO: 6959 - RNA, 4263 nt, Artificial Sequence
  Cas9 variant mRNA product
auggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauga

SEQ ID NO: 6960 - RNA, 3345 nt, Artificial Sequence
  Cas9 variant mRNA product
auggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauga

SEQ ID NO: 6961 - RNA, 4101 nt, Artificial Sequence
  Cas9 variant mRNA product
auggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauga

SEQ ID NO: 6962 - RNA, 4134 nt, Artificial Sequence
  Cas9 variant mRNA product
auggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguga

SEQ ID NO: 6963 - RNA, 3267 nt, Artificial Sequence
  Cas9 variant mRNA product
auggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauga

SEQ ID NO: 6964 - RNA, 3345 nt, Artificial Sequence
  Cas9 variant mRNA product
auggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauga

SEQ ID NO: 6965 - RNA, 3351 nt, Artificial Sequence
  Cas9 variant mRNA product
auggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauga

SEQ ID NO: 6966 - RNA, 3051 nt, Artificial Sequence
  Cas9 variant mRNA product
auggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauga

SEQ ID NO: 6967 - RNA, 3462 nt, Artificial Sequence
  Cas9 variant mRNA product
auggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauga

SEQ ID NO: 6968 - RNA, 4020 nt, Artificial Sequence
  Cpf1 variant mRNA product
auggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauga

SEQ ID NO: 6969 - RNA, 3999 nt, Artificial Sequence
  Cpf1 variant mRNA product
auggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauga

SEQ ID NO: 6970 - RNA, 4716 nt, Artificial Sequence
  Cas9 variant mRNA product
gggagagucccgcagucggcguccagcggcucugcuuguucgugugugugucguugcaggccuuauucaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6971 - RNA, 5499 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6972 - RNA, 3771 nt, Artificial Sequence
  Cas9 variant mRNA product
gggagagucccgcagucggcguccagcggcucugcuuguucgugugugugucguugcaggccuuauucaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6973 - RNA, 4839 nt, Artificial Sequence
  Cas9 variant mRNA product
gggagagucccgcagucggcguccagcggcucugcuuguucgugugugugucguugcaggccuuauucaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6974 - RNA, 3915 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6975 - RNA, 4776 nt, Artificial Sequence
  Cas9 variant mRNA product
gggagagucccgcagucggcguccagcggcucugcuuguucgugugugugucguugcaggccuuauucaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6976 - RNA, 3858 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6977 - RNA, 4614 nt, Artificial Sequence
  Cas9 variant mRNA product
gggagagucccgcagucggcguccagcggcucugcuuguucgugugugugucguugcaggccuuauucaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6978 - RNA, 4647 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6979 - RNA, 3780 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6980 - RNA, 3858 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6981 - RNA, 3864 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6982 - RNA, 3564 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6983 - RNA, 3975 nt, Artificial Sequence
  Cas9 variant mRNA product
gggagagucccgcagucggcguccagcggcucugcuuguucgugugugugucguugcaggccuuauucaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6984 - RNA, 4533 nt, Artificial Sequence
  Cpf1 variant mRNA product
gggagagucccgcagucggcguccagcggcucugcuuguucgugugugugucguugcaggccuuauucaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6985 - RNA, 4512 nt, Artificial Sequence
  Cpf1 variant mRNA product
gggagagucccgcagucggcguccagcggcucugcuuguucgugugugugucguugcaggccuuauucaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6986 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6987 - RNA, 5596 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6988 - RNA, 3868 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6989 - RNA, 4936 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6990 - RNA, 4012 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6991 - RNA, 4873 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6992 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6993 - RNA, 4711 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6994 - RNA, 4744 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6995 - RNA, 3877 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6996 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6997 - RNA, 3961 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6998 - RNA, 3661 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 6999 - RNA, 4072 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 7000 - RNA, 4630 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 7001 - RNA, 4609 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 7002 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7003 - RNA, 5280 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7004 - RNA, 3552 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7005 - RNA, 4620 nt, Artificial Sequence
  Cas9 variant mRNA product
gggagagcggcucggccauuuugucccagucaguccggaggcugcggcugcagaaguaccgccugcggaguaacugcaaagaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7006 - RNA, 3696 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7007 - RNA, 4557 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7008 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7009 - RNA, 4395 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7010 - RNA, 4428 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7011 - RNA, 3561 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7012 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7013 - RNA, 3645 nt, Artificial Sequence
  Cas9 variant mRNA product
gggagagcggcucggccauuuugucccagucaguccggaggcugcggcugcagaaguaccgccugcggaguaacugcaaagaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7014 - RNA, 3345 nt, Artificial Sequence
  Cas9 variant mRNA product
gggagagcggcucggccauuuugucccagucaguccggaggcugcggcugcagaaguaccgccugcggaguaacugcaaagaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7015 - RNA, 3756 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7016 - RNA, 4314 nt, Artificial Sequence
  Cpf1 variant mRNA product
gggagagcggcucggccauuuugucccagucaguccggaggcugcggcugcagaaguaccgccugcggaguaacugcaaagaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7017 - RNA, 4293 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7018 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7019 - RNA, 5222 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7020 - RNA, 3494 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7021 - RNA, 4562 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7022 - RNA, 3638 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7023 - RNA, 4499 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7024 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7025 - RNA, 4337 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7026 - RNA, 4370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7027 - RNA, 3503 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7028 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7029 - RNA, 3587 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7030 - RNA, 3287 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7031 - RNA, 3698 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7032 - RNA, 4256 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7033 - RNA, 4235 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7034 - RNA, 4420 nt, Artificial Sequence
  Cas9 variant mRNA product
gggagagucccgcagucggcguccagcggcucugcuuguucgugugugugucguugcaggccuuauucaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7035 - RNA, 5203 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7036 - RNA, 3475 nt, Artificial Sequence
  Cas9 variant mRNA product
gggagagucccgcagucggcguccagcggcucugcuuguucgugugugugucguugcaggccuuauucaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7037 - RNA, 4543 nt, Artificial Sequence
  Cas9 variant mRNA product
gggagagucccgcagucggcguccagcggcucugcuuguucgugugugugucguugcaggccuuauucaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7038 - RNA, 3619 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7039 - RNA, 4480 nt, Artificial Sequence
  Cas9 variant mRNA product
gggagagucccgcagucggcguccagcggcucugcuuguucgugugugugucguugcaggccuuauucaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7040 - RNA, 3562 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7041 - RNA, 4318 nt, Artificial Sequence
  Cas9 variant mRNA product
gggagagucccgcagucggcguccagcggcucugcuuguucgugugugugucguugcaggccuuauucaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7042 - RNA, 4351 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7043 - RNA, 3484 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7044 - RNA, 3562 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7045 - RNA, 3568 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7046 - RNA, 3268 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7047 - RNA, 3679 nt, Artificial Sequence
  Cas9 variant mRNA product
gggagagucccgcagucggcguccagcggcucugcuuguucgugugugugucguugcaggccuuauucaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7048 - RNA, 4237 nt, Artificial Sequence
  Cpf1 variant mRNA product
gggagagucccgcagucggcguccagcggcucugcuuguucgugugugugucguugcaggccuuauucaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7049 - RNA, 4216 nt, Artificial Sequence
  Cpf1 variant mRNA product
gggagagucccgcagucggcguccagcggcucugcuuguucgugugugugucguugcaggccuuauucaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7050 - RNA, 4530 nt, Artificial Sequence
  Cas9 variant mRNA product
gggagaggcgcugccuacggagguggcagccaucuccuucucggcaucaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7051 - RNA, 5313 nt, Artificial Sequence
  Cas9 variant mRNA product
gggagaggcgcugccuacggagguggcagccaucuccuucucggcaucaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7052 - RNA, 3585 nt, Artificial Sequence
  Cas9 variant mRNA product
gggagaggcgcugccuacggagguggcagccaucuccuucucggcaucaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7053 - RNA, 4653 nt, Artificial Sequence
  Cas9 variant mRNA product
gggagaggcgcugccuacggagguggcagccaucuccuucucggcaucaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7054 - RNA, 3729 nt, Artificial Sequence
  Cas9 variant mRNA product
gggagaggcgcugccuacggagguggcagccaucuccuucucggcaucaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7055 - RNA, 4590 nt, Artificial Sequence
  Cas9 variant mRNA product
gggagaggcgcugccuacggagguggcagccaucuccuucucggcaucaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7056 - RNA, 3672 nt, Artificial Sequence
  Cas9 variant mRNA product
gggagaggcgcugccuacggagguggcagccaucuccuucucggcaucaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7057 - RNA, 4428 nt, Artificial Sequence
  Cas9 variant mRNA product
gggagaggcgcugccuacggagguggcagccaucuccuucucggcaucaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7058 - RNA, 4461 nt, Artificial Sequence
  Cas9 variant mRNA product
gggagaggcgcugccuacggagguggcagccaucuccuucucggcaucaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7059 - RNA, 3594 nt, Artificial Sequence
  Cas9 variant mRNA product
gggagaggcgcugccuacggagguggcagccaucuccuucucggcaucaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7060 - RNA, 3672 nt, Artificial Sequence
  Cas9 variant mRNA product
gggagaggcgcugccuacggagguggcagccaucuccuucucggcaucaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7061 - RNA, 3678 nt, Artificial Sequence
  Cas9 variant mRNA product
gggagaggcgcugccuacggagguggcagccaucuccuucucggcaucaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7062 - RNA, 3378 nt, Artificial Sequence
  Cas9 variant mRNA product
gggagaggcgcugccuacggagguggcagccaucuccuucucggcaucaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7063 - RNA, 3789 nt, Artificial Sequence
  Cas9 variant mRNA product
gggagaggcgcugccuacggagguggcagccaucuccuucucggcaucaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7064 - RNA, 4347 nt, Artificial Sequence
  Cpf1 variant mRNA product
gggagaggcgcugccuacggagguggcagccaucuccuucucggcaucaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7065 - RNA, 4326 nt, Artificial Sequence
  Cpf1 variant mRNA product
gggagaggcgcugccuacggagguggcagccaucuccuucucggcaucaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 7066 - RNA, 4582 nt, Artificial Sequence
  Cas9 variant mRNA product
ggggcgcugccuacggagguggcagccaucuccuucucggcaucaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7067 - RNA, 5365 nt, Artificial Sequence
  Cas9 variant mRNA product
ggggcgcugccuacggagguggcagccaucuccuucucggcaucaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7068 - RNA, 3637 nt, Artificial Sequence
  Cas9 variant mRNA product
ggggcgcugccuacggagguggcagccaucuccuucucggcaucaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7069 - RNA, 4705 nt, Artificial Sequence
  Cas9 variant mRNA product
ggggcgcugccuacggagguggcagccaucuccuucucggcaucaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7070 - RNA, 3781 nt, Artificial Sequence
  Cas9 variant mRNA product
ggggcgcugccuacggagguggcagccaucuccuucucggcaucaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7071 - RNA, 4642 nt, Artificial Sequence
  Cas9 variant mRNA product
ggggcgcugccuacggagguggcagccaucuccuucucggcaucaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7072 - RNA, 3724 nt, Artificial Sequence
  Cas9 variant mRNA product
ggggcgcugccuacggagguggcagccaucuccuucucggcaucaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7073 - RNA, 4480 nt, Artificial Sequence
  Cas9 variant mRNA product
ggggcgcugccuacggagguggcagccaucuccuucucggcaucaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7074 - RNA, 4513 nt, Artificial Sequence
  Cas9 variant mRNA product
ggggcgcugccuacggagguggcagccaucuccuucucggcaucaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7075 - RNA, 3646 nt, Artificial Sequence
  Cas9 variant mRNA product
ggggcgcugccuacggagguggcagccaucuccuucucggcaucaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7076 - RNA, 3724 nt, Artificial Sequence
  Cas9 variant mRNA product
ggggcgcugccuacggagguggcagccaucuccuucucggcaucaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7077 - RNA, 3730 nt, Artificial Sequence
  Cas9 variant mRNA product
ggggcgcugccuacggagguggcagccaucuccuucucggcaucaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7078 - RNA, 3430 nt, Artificial Sequence
  Cas9 variant mRNA product
ggggcgcugccuacggagguggcagccaucuccuucucggcaucaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7079 - RNA, 3841 nt, Artificial Sequence
  Cas9 variant mRNA product
ggggcgcugccuacggagguggcagccaucuccuucucggcaucaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7080 - RNA, 4399 nt, Artificial Sequence
  Cpf1 variant mRNA product
ggggcgcugccuacggagguggcagccaucuccuucucggcaucaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7081 - RNA, 4378 nt, Artificial Sequence
  Cpf1 variant mRNA product
ggggcgcugccuacggagguggcagccaucuccuucucggcaucaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7082 - RNA, 4484 nt, Artificial Sequence
  Cas9 variant mRNA product
gggagagucccgcagucggcguccagcggcucugcuuguucgugugugugucguugcaggccuuauucaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7083 - RNA, 5267 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7084 - RNA, 3539 nt, Artificial Sequence
  Cas9 variant mRNA product
gggagagucccgcagucggcguccagcggcucugcuuguucgugugugugucguugcaggccuuauucaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7085 - RNA, 4607 nt, Artificial Sequence
  Cas9 variant mRNA product
gggagagucccgcagucggcguccagcggcucugcuuguucgugugugugucguugcaggccuuauucaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7086 - RNA, 3683 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7087 - RNA, 4544 nt, Artificial Sequence
  Cas9 variant mRNA product
gggagagucccgcagucggcguccagcggcucugcuuguucgugugugugucguugcaggccuuauucaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7088 - RNA, 3626 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7089 - RNA, 4382 nt, Artificial Sequence
  Cas9 variant mRNA product
gggagagucccgcagucggcguccagcggcucugcuuguucgugugugugucguugcaggccuuauucaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7090 - RNA, 4415 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7091 - RNA, 3548 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7092 - RNA, 3626 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7093 - RNA, 3632 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7094 - RNA, 3332 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7095 - RNA, 3743 nt, Artificial Sequence
  Cas9 variant mRNA product
gggagagucccgcagucggcguccagcggcucugcuuguucgugugugugucguugcaggccuuauucaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7096 - RNA, 4301 nt, Artificial Sequence
  Cpf1 variant mRNA product
gggagagucccgcagucggcguccagcggcucugcuuguucgugugugugucguugcaggccuuauucaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7097 - RNA, 4280 nt, Artificial Sequence
  Cpf1 variant mRNA product
gggagagucccgcagucggcguccagcggcucugcuuguucgugugugugucguugcaggccuuauucaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7098 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7099 - RNA, 5364 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7100 - RNA, 3636 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7101 - RNA, 4704 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7102 - RNA, 3780 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7103 - RNA, 4641 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7104 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7105 - RNA, 4479 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7106 - RNA, 4512 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7107 - RNA, 3645 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7108 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7109 - RNA, 3729 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7110 - RNA, 3429 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7111 - RNA, 3840 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7112 - RNA, 4398 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7113 - RNA, 4377 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 7114 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7115 - RNA, 5300 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7116 - RNA, 3572 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7117 - RNA, 4640 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7118 - RNA, 3716 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7119 - RNA, 4577 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7120 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7121 - RNA, 4415 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7122 - RNA, 4448 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7123 - RNA, 3581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7124 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7125 - RNA, 3665 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7126 - RNA, 3365 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7127 - RNA, 3776 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7128 - RNA, 4334 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7129 - RNA, 4313 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7130 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7131 - RNA, 5249 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7132 - RNA, 3521 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7133 - RNA, 4589 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7134 - RNA, 3665 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7135 - RNA, 4526 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7136 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7137 - RNA, 4364 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7138 - RNA, 4397 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7139 - RNA, 3530 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7140 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7141 - RNA, 3614 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7142 - RNA, 3314 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7143 - RNA, 3725 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7144 - RNA, 4283 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7145 - RNA, 4262 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 7146 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7147 - RNA, 5235 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7148 - RNA, 3507 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7149 - RNA, 4575 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7150 - RNA, 3651 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7151 - RNA, 4512 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7152 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7153 - RNA, 4350 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7154 - RNA, 4383 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7155 - RNA, 3516 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7156 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7157 - RNA, 3600 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7158 - RNA, 3300 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7159 - RNA, 3711 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7160 - RNA, 4269 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7161 - RNA, 4248 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7162 - RNA, 4433 nt, Artificial Sequence
  Cas9 variant mRNA product
gggagagucccgcagucggcguccagcggcucugcuuguucgugugugugucguugcaggccuuauucaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7163 - RNA, 5216 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7164 - RNA, 3488 nt, Artificial Sequence
  Cas9 variant mRNA product
gggagagucccgcagucggcguccagcggcucugcuuguucgugugugugucguugcaggccuuauucaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7165 - RNA, 4556 nt, Artificial Sequence
  Cas9 variant mRNA product
gggagagucccgcagucggcguccagcggcucugcuuguucgugugugugucguugcaggccuuauucaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7166 - RNA, 3632 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7167 - RNA, 4493 nt, Artificial Sequence
  Cas9 variant mRNA product
gggagagucccgcagucggcguccagcggcucugcuuguucgugugugugucguugcaggccuuauucaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7168 - RNA, 3575 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7169 - RNA, 4331 nt, Artificial Sequence
  Cas9 variant mRNA product
gggagagucccgcagucggcguccagcggcucugcuuguucgugugugugucguugcaggccuuauucaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7170 - RNA, 4364 nt, Artificial Sequence
  Cas9 variant mRNA product
gggagagucccgcagucggcguccagcggcucugcuuguucgugugugugucguugcaggccuuauucaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7171 - RNA, 3497 nt, Artificial Sequence
  Cas9 variant mRNA product
gggagagucccgcagucggcguccagcggcucugcuuguucgugugugugucguugcaggccuuauucaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7172 - RNA, 3575 nt, Artificial Sequence
  Cas9 variant mRNA product
gggagagucccgcagucggcguccagcggcucugcuuguucgugugugugucguugcaggccuuauucaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7173 - RNA, 3581 nt, Artificial Sequence
  Cas9 variant mRNA product
gggagagucccgcagucggcguccagcggcucugcuuguucgugugugugucguugcaggccuuauucaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7174 - RNA, 3281 nt, Artificial Sequence
  Cas9 variant mRNA product
gggagagucccgcagucggcguccagcggcucugcuuguucgugugugugucguugcaggccuuauucaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7175 - RNA, 3692 nt, Artificial Sequence
  Cas9 variant mRNA product
gggagagucccgcagucggcguccagcggcucugcuuguucgugugugugucguugcaggccuuauucaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7176 - RNA, 4250 nt, Artificial Sequence
  Cpf1 variant mRNA product
gggagagucccgcagucggcguccagcggcucugcuuguucgugugugugucguugcaggccuuauucaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7177 - RNA, 4229 nt, Artificial Sequence
  Cpf1 variant mRNA product
gggagagucccgcagucggcguccagcggcucugcuuguucgugugugugucguugcaggccuuauucaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 7178 - RNA, 51 nt, Artificial Sequence
  NLS2 variant
auggcgcccaaaaaaaaacgcaaagucggaauccacggcgugcccgcggcc

SEQ ID NO: 7179 - RNA, 48 nt, Artificial Sequence
  NLS4 variant
aaaaggccggcggcaacaaaaaaggcagggcaggcgaaaaaaaaaaag

SEQ ID NO: 7180 - RNA, 4107 nt, Artificial Sequence
  Cas9 variant
auggacaagaaguacucaaucggccuugacaucgggaccaacuccgugggcugggccgucaucaccgaugaauacaaggugcccagcaagaaguucaaggugcuggggaauacggaccgccacuccaucaagaagaaucugauaggcgcccuucuguucgacucuggggagacugcggaagccacgagacugaaacgcaccgcgcggcgccgcuacacgcggcgcaagaaccgcaucugcuaccugcaagagaucuucuccaacgagauggcaaaggucgacgacucuuucuuccaucggcucgaggaguccuuccugguggaagaagacaagaagcacgagcgccacccgaucuucggcaacauaguggacgaggucgcauaccacgaaaaguaccccaccaucuaccaccucagaaagaagcucguggacagcacagacaaggcggaccugcgccugaucuaccucgcccuggcccacaugaucaaguuccggggccacuuccugaucgagggggaccucaaucccgauaacuccgacguggacaagcuguucauccagcugguccagaccuacaaucagcuguucgaggagaaccccaucaacgccucgggcguugacgcgaaagccauccugucugcccgucugagcaagucccggcgccucgaaaaccugaucgcccaguugcccggggagaagaagaacggucuauucgggaaccuuaucgcccugagccucggccugacgcccaacuucaaguccaacuucgauuuggcggaggacgccaagcuccagcugagcaaggacaccuacgacgacgaccuggacaaccuccuagcccagaucggagaccaguacgcagaccuguuucucgcggcaaagaaucugucagacgccauccugcuaagcgacaucuugcgggugaacaccgagauaaccaaggccccgcuguccgcaucgaugaucaagcgcuacgaugagcaucaccaggaucucacgcugcugaaggcccucguccggcagcagcuccccgagaaguacaaggaaaucuucuucgaccagucaaagaacggguacgcgggcuacauagacggaggcgccucccaggaagaguucuacaaguucauuaagccaauccuagagaagauggacggcaccgaagaacuccuggugaaacugaaccgcgaggaccugcuccggaagcagcgcaccuucgacaacgguaguaucccucaccaaauccaccucggagagcugcacgccauccuccgccggcaggaggacuucuaccccuuccugaaggacaaccgcgagaagaucgagaagauccugaccuuucggauccccuacuacguggggccgcucgcccgcggcaacucccgguucgccuggaugacgcgcaagagcgaagagaccaucacccccuggaacuuugaggaagucguggacaagggagcguccgcccagagcuucaucgagagaaugacaaacuucgauaagaaccuccccaacgagaaggugcuucccaaacacucccuccuguacgaguacuucacggucuacaacgaguuaaccaaggugaaauacgugaccgagggaaugcgcaagccggccuuucucagcggcgagcagaagaaagcaauuguagaucugcuguucaaaaccaaccggaaggugacagugaagcaguugaaggaggacuacuucaagaagaucgagugcuucgacuccgucgagaucagcgggguugaggaccgguucaacgccucccugggcaccuaccacgaccugcucaagaucaucaaggacaaggacuucuuagacaacgaggagaacgaagacauccuugaggacauuguccucacccuuacccucuucgaggaucgggagaugauugaggagaggcucaagacguacgcccaccuguucgaugacaaggugaugaagcagcucaagcggcgccgguacaccggguggggccgccucagccggaagcugaucaacgggauccgcgacaagcaguccggcaagaccauacuggacuuccuaaagagcgacggcuucgccaaccgcaacuucaugcagcugauccacgacgacucccugaccuuuaaggaggacauacagaaggcccaggugagcgggcagggcgacucucuccacgagcacaucgcgaaccuagcuggaagccccgccauaaagaagggcauccugcagacaguuaaggugguggacgagcucgucaaggugauggggcgccacaagcccgagaacaucgugaucgagauggcccgcgaaaaucagaccacccagaagggccagaaaaacucccgggagcgcaugaagcggaucgaggagggcauuaaagagcuagggagccagauccucaaggagcacccaguagagaauacccagcuccaaaacgagaaacuguaccuguacuaccuccagaauggccgcgacauguacguggaccaggagcuagacaucaaccggcuaagcgacuacgacguggaccacauagucccgcagaguuuccucaaggacgacagcaucgacaacaaggugcugacgcgcuccgacaaaaaccgcggcaaaagcgacaacgugccauccgaggaagucgugaagaagaugaagaacuauuggcgccagcugcucaacgccaagcugaucacccagcggaaguucgacaacuuaaccaaggccgagagagggggccucagcgagcuggacaaggcuggguuuaucaagcgacaguuaguagagacccgccagaucaccaagcacgucgcccaaauccucgacucccgcaugaacacgaaguacgacgagaacgacaagcugauacgcgaggugaaggugaucacccucaagagcaagcucguuuccgacuuccgaaaggacuuccaguucuacaagguacgcgagaucaauaacuaccaccacgcccaugacgccuaucugaacgccguagucggcaccgcgcugaucaagaaguaccccaaacucgagagcgaguucguguacggggacuacaagguguacgacgucagaaaaaugaucgccaaguccgaacaggagaucggcaaggcaaccgccaaguacuucuucuauagcaacaucaugaacuucuucaagacggagaucacccuugccaacggggagauccgcaagcggcccuuaauagagaccaacggcgagaccggcgagaucgugugggacaaggggcgcgacuucgccacggugcggaaggugcucucuaugccucaggucaacaucgugaagaagaccgagguccagaccggcggguuuagcaaggagucgauccugcccaaacgcaacagcgacaagcugauagcccgcaagaaggacugggaccccaagaaguacggcggauucgacucacccaccguagccuacagcgugcucgucguggcaaagguggaaaagggaaagagcaagaagcugaaguccguuaaagagcugcucggcaucacuaucauggaacggagcuccuucgagaagaacccgaucgauuuccuggaggcaaagggguacaaggagguuaagaaggaccugaucaucaagcuccccaaguacucgcuauucgagcuagagaacggccgcaagcggaugcuagccuccgcaggggagcugcagaagggcaacgagcuggcccuccccucgaaguacguaaacuuccuauaccuagccucccacuacgagaagcucaaggggucaccugaggacaacgagcagaagcaacuguucgucgagcaacacaaacacuaccuggacgagaucaucgagcagaucuccgaauuuagcaagcgcgugauccucgcggacgcgaaccuggacaaagugcuguccgccuacaacaaacaucgggacaagcccauccgcgagcaggccgagaauaucauccaccucuucacacugaccaaccugggcgcccccgcggccuucaaguacuucgacaccacgaucgaccggaagcgcuacaccucgaccaaggaggugcucgaugccacccuaauccaucaguccaucacgggcuuguacgagacccggaucgaccucagccagcucgggggagacuga

SEQ ID NO: 7181 - RNA, 4890 nt, Artificial Sequence; identical to SEQ ID NO: 1381
  Cas9 variant

SEQ ID NO: 7182 - RNA, 3162 nt, Artificial Sequence
  Cas9 variant
augaaacgcaacuacauccuggggcucgacaucggaaucaccagcgugggcuacgggaucaucgacuacgagacccgggaugugaucgacgccggcgugcgccuguucaaggaggcaaacguggaaaacaacgaagggcggcgcaguaagcggggcgcccgccggcugaagcgccggcgccggcaccguauccagcgggugaagaagcuccuuuuugacuacaaccugcucacggaccacuccgagcuguccgguaucaaccccuacgaggcccgcgugaaggggcugagccagaagcucucagaggaagaguucagcgccgcccugcugcaccucgccaagcggcgcggcgugcacaacgucaaugaaguggaggaggacaccgggaacgagcuguccaccaaggagcagaucagccggaacuccaaggcgcuggaggagaaguacguggccgagcuccagcuggagcgccugaaaaaggacggcgaaguccgggggagcauaaaucgcuucaagaccagcgacuauguuaaggaggccaaacagcuccucaaggugcagaaagccuaccaccagcuagaccagagcuucaucgacacauacaucgaccuccuggagacccggcgcacguacuaugagggcccgggcgaggggucccccuucggcuggaaagacaucaaggagugguacgagaugcugauggggcacugcaccuacuuccccgaggagcuccgcuccgugaaguacgcguacaacgcggaccuguacaacgcacugaacgaccuuaacaaccuggugaucacgcgagacgagaacgagaagcuggaauacuacgagaaguuccagaucaucgagaacguguucaaacaaaagaagaagcccacccucaagcagaucgccaaggagauccuggucaacgaagaggacaucaagggcuaccgcgugaccuccaccggcaagccggaguucacgaaccugaagguguaccacgacaucaaggacaucaccgcccggaaggagaucaucgagaacgcagagcucuuagaccagaucgccaagauacugaccaucuaccagagcagcgaggacauccaggaggagcucaccaaccugaacagcgagcuuacgcaggaggagaucgagcagaucuccaaccucaagggguacacuggcacccacaaccugagccugaaggccaucaaccucauccuggacgagcuguggcacaccaacgacaaccagaucgccaucuucaaccgccucaagcugguccccaagaagguggaccugucacagcagaaggagauccccacgaccuugguggacgacuucauccugucccccgucgugaaacggagcuucauccaguccaucaagguuaucaacgccauuaucaagaaguacgggcugccuaacgacauuaucauagagcuggcgcgcgagaagaacagcaaggacgcacagaagaugaucaacgagaugcagaagcggaaccgccagacgaacgagcggaucgaggagaucauccgcaccacgggcaaggagaacgccaaguaccucaucgagaagaucaagcugcacgacaugcaggaagggaagugccuguacucccuugaagccaucccccuggaggaccugcucaauaaccccuucaacuacgaaguugaccacaucaucccgcggagcguguccuucgacaacagcuucaacaacaaaguccugguaaagcaggaggagaacuccaagaagggcaaccgcaccccguuccaguaccugagcuccagcgacagcaagauuagcuacgagaccuucaagaagcacauucuuaaccuggccaagggcaaggggcggaucuccaagaccaagaaggaauaccugcucgaggagcgcgacaucaaccgguucagcgugcaaaaggauuucaucaaccgcaacuuggucgacacgcgguacgcaacgcgcggccugaugaaccuccuucgguccuacuucagggugaacaaccucgacgugaaggucaaaagcaucaacgggggcuucaccuccuuccuccgccggaaguggaaguucaagaaggagcgcaacaagggguauaagcaccacgccgaggacgcccugaucaucgccaacgccgacuucaucuucaaggaguggaagaagcuggacaaggcgaaaaaggugauggagaaccagauguucgaggagaagcaggccgaauccaugcccgagaucgagaccgagcaggaguacaaggaaaucuucaucacgccccaccagauaaaacacauuaaggacuucaaggacuacaaauacagccaccggguggacaagaagcccaaccgcgaacucauaaacgacacccuauauuccacccggaaagacgacaagggcaacacccugaucgucaacaaccucaacggccuguacgacaaggacaacgacaagcugaagaagcucauuaacaagagcccggagaagcugcugauguaccaccacgacccccagacguaccagaagcucaagcugaucauggagcaguacggggacgagaagaacccccuguacaaguacuacgaagagaccggcaacuaccucaccaaguacuccaagaaggacaacgggcccgugaucaagaagaucaaguacuauggcaacaaacugaacgcccaccuggacaucacggacgacuacccgaacagccgcaacaagguggucaaguuaucccuuaaacccuaccgguucgacguguaccuugacaacgggguguacaaguucgucaccgugaagaaucucgacgugaucaagaaggagaacuacuacgaagucaacagcaagugcuacgaggaggccaagaaacugaaaaagaucuccaaccaggcggaguucaucgcgagcuucuacaacaacgaccugaucaagauuaacggggagcuuuaccgcgugaucggcgugaacaacgaccugcugaaccggaucgaggucaacaugaucgacaucacguaccgcgaguaccuugagaacaugaaugacaagcguccgccccggaucaucaagacaaucgccuccaagacccagagcaucaagaaauacuccaccgacauccuggggaaccuguacgagguaaagagcaagaagcacccccagaucaucaagaaaggcuga

SEQ ID NO: 7183 - RNA, 4230 nt, Artificial Sequence; identical to SEQ ID NO: 1383
  Cas9 variant

SEQ ID NO: 7184 - RNA, 3306 nt, Artificial Sequence
  Cas9 variant
augugguacgccagucucaugagcgcccaccaucuucgcgucggcaucgacgucggcacccacuccgucggccuggcaacccugcgagucgacgaccacggcacaccuauagagcuccuaagcgcgcucagccacauacaugacaguggggucggaaaagaaggcaagaaagaccacgauacccgcaaaaagcuaucaggcauagcaaggcgggcccgcaggcuccugcaccaccgacgcacccaacuacaacaacuagacgaaguacuacgcgaucugggcuuccccauaccaacacccggugaguuccuggaccucaacgagcaaaccgacccauacagagucuggcgaguaagagcccgacucgucgaagaaaaauuacccgaggaacuucgaggccccgcaaucagcauggccguucgacacaucgcacgacacagaggauggcgaaaccccuacaguaaggucgagucacuuuuaagcccggccgaagaaagccccuucaugaaggcgcugcgcgagcgcauccuagcaaccacgggggaaguccucgaugacggaauaacaccuggccaagcaauggcccaagucgcacucacacauaauauauccaugcgagguccagaaggcauacuggguaaacuacaccaaagcgacaacgccaacgaaauccggaaaauuugcgcgcgacaaggcguguccccagacguauguaaacaacuacugcgagcaguuuucaaagcagacagccccaggggguccgcagucucaagaguagccccagacccccucccaggucaagggagcuuccgacgggcaccaaaaugcgacccagaguuccaaagauuccggauaauaagcauagucgcaaaccugcgcaucagcgaaaccaaaggcgaaaacagaccacucaccgcagacgaacgacggcacgucguaacuuuccuuaccgaagacucccaggcggaccucaccugggucgacguagccgaaaaacuaggaguacaccgacgggaccuacgcggcacagcaguacacacagacgacggcgagagaagcgccgccagaccacccaucgaugccacagaccgaauaaugcgacaaaccaaaauaagcagccuuaaaaccuggugggaagaagcugauagcgaacagcgaggcgccaugauaagauaccuauacgaagaccccacagacucggaaugcgccgagauaauagccgaacuacccgaagaggaccaagccaaacuugacagccuacaccuacccgcagggagggcggcguauagcagagaaucacuaacggcgcuuuccgaccacaugcuagcaacaaccgacgaccugcacgaggcacguaagcgccuauucggcgucgacgacagcugggcaccgccagcugaagccauaaacgcaccagucggaaacccauccguagaccggacacugaaaaucgucgggcgcuaccuuagcgcgguugaaucaauguggggaacacccgagguaauccacguagagcacgucagagacgguuucaccagcgaaagaauggccgacgaacgcgacaaggcaaacagacgaagauauaacgacaaccaggaagccaugaaaaagauccaacgagacuacgggaaagaaggguacaucagccgaggugacauagugagacucgacgcacuggaacuccaaggcugcgccugucucuacugcggaacaacaauaggauaccauaccugccagcuagaccacaucguaccccaagcaggacccggaagcaacaaccgaaggggaaaccuggucgcaguaugcgaacggugcaaccgcaguaagagcaacacaccguucgcaguaugggcgcaaaaaugcggaaucccccacguaggggucaaggaggcaaucggacgagucaggggauggcgcaagcaaaccccgaacacgagcagcgaggaccucacacggcucaagaaagaagucauagcccgacuaaggcgcacgcaagaggaucccgaaauagacgagaggucgauggaaagcguggccuggauggcaaacgaacuccaccaccgcauagcagcggccuacccugagacuacgguaauggucuacagagguucaauaacugcagcagcgagaaaagcugcaggcauagacagccgaauuaaccuaaucggcgaaaaaggacgaaaagaccgaauagacaggcgucaccacgcaguggacgccucugugguagcacucauggaggcgucaguggcaaaaacacuagcagaacgcagcaguuugagaggggagcagcgacugacaggaaaagaacaaacauggaaacaauacaccgggagcacugucggagcccgagagcacuucgaaauguggcgcggccacaugcuucaccuaacagaacuguucaacgaacgccucgcggaggacaaaguauacgucacgcaaaacauacgccuccgacugagcgauggaaacgcccacacagucaacccgucaaagcucgucucacaccgccucggagaugggcugaccgugcaacagauagaccgcgcaugcacccccgcacuauggugugcgcuuaccagagagaaagacuucgacgagaaaaacggccuacccgcacgagaagaccgagcgauccgcguacacggacacgagauaaaauccucggacuacauacaagucuucucgaagcgcaaaaagacagacucggacagggacgaaacgcccuucggagccaucgcggucagaggaggcuucguagaaaucggaccgucaauacaccacgcccggauauacagaguggaagggaaaaagccaguuuacgcaaugcucagaguauucacccacgaccuccucucccaaaggcacggagaccucuucagcgcagucauaccaccacaaucuaucucaaugcgcugcgcagaaccaaaacuaagaaaagccauaacuacggggaacgccacauaccucggauggguaguaguaggcgacgaacuagagauaaacgucgauucguuuacaaaauacgcgauaggacgguuucuagaagauuuccccaacacaacccgauggagaauuugcggcuaugacacgaacucgaaacucacacuaaaaccaauugugcuagcggcagaaggacuggaaaaucccuccagcgccguaaacgagauagucgaacuaaaaggauggcgcguagccauuaacguccuaaccaaaguacauccaacgguaguacgccgagacgcccugggcagaccaagauacagcucccgcuccaaccucccaacaagcuggacaauagaauga

SEQ ID NO: 7185 - RNA, 4167 nt, Artificial Sequence; identical to SEQ ID NO: 1385
  Cas9 variant

SEQ ID NO: 7186 - RNA, 3249 nt, Artificial Sequence
  Cas9 variant
auggcagcuuucaaaccgaacucaaucaacuacauacuaggacuagacauaggcaucgcgagcgucggcugggccauggucgaaauugacgaagaggaaaacccaauccgacuuauagaccucgggguaagaguauucgaaagagccgaagucccaaaaacgggggacagccuagcgauggccaggagacuagcacgcuccgugcgucgacucacaagacgccgagcccacagacugcucagaacacgcagacuccugaaacgggagggaguccuucaagcagccaacuuugacgaaaacgggcucauuaaaucacucccgaacaccccauggcagcugcgagcggcagcacucgaccgaaaacucaccccacucgaauggagcgcaguccuccuucaccugaucaaacaccgagguuaucuaucccagcgcaaaaacgaaggggaaacagcagacaaagaacucggcgcacuccucaaaggaguggccgggaacgcccacgcacuacaaacaggcgacuucagaaccccagccgagcucgcacuaaacaaauucgaaaaagaauccggacacauacguaaccaacgaucagacuacagccacacauucuccaggaaagaccuacaggccgaacucauacuccuauucgaaaaacaaaaagaguucggcaacccacauguauccggaggacuaaaggaaggaaucgaaacgcuacuaaugacccagaggccagcccuaagcggugacgcuguccagaaaaugcucggucauuguacauucgagccggcugaaccgaaagcagcaaagaacacuuauacagcagaacgauucaucuggcucacaaaacucaauaaccugagaauccucgagcaaggauccgaacggccacuaacagacacagaacgcgcaacgcucauggacgaaccauaccgaaagucaaaacuuaccuacgcacaagcucgcaaacuccugggacuagaagacacugcauucuuuaaaggccuccgguacggaaaagacaacgcggaagcauccacacucauggagaugaaagccuaccacgccauaucgagagcccuagaaaaggaggggcuaaaggacaagaaaagcccccucaaccucagcccggagcuucaagacgaaauaggcacagccuucucccucuucaagacggacgaagacaucacaggcagacuuaaagacagaauccagccggagauacuggaagccuuacucaaacacaucagcuucgacaaauucguacaaaucucucucaaagcccuccgcagaauaguaccucucauggaacaagggaaacgcuaugacgaagccugugccgaaaucuacggcgaccacuacgggaagaaaaauacggaagagaaaaucuaccuaccgcccauccccgcagacgaaauccgaaacccagucguccuccgcgcauugucacaggcacgaaagguaaucaacggcgucguacgucgcuacggcuccccggcucgaauccacauagaaacagcccgugaaguagggaaaucauucaaagacagaaaagaaauagaaaagcgccaagaagaaaaccggaaagaccgagaaaaggcagcagcaaaguuccgagaauacuucccaaacuucguaggcgaaccaaagagcaaagacauacuaaaacuuagguuauacgagcagcaacacggcaagugccuauacucaggaaaggaaauaaaccuaggccgccucaaugaaaaaggcuacgucgaaaucgaccacgcccugccguucuccaggaccugggacgacagcuucaacaacaaaguucucguccucggcagcgaaaaucaaaacaaaggaaaccagacaccuuacgaauacuucaacggaaaggacaacagccgagaguggcaagaguucaaggcaagaguggaaacaucccgauucccccgcucgaaaaagcagcgcauccuacuacaaaaauucgacgaggacggcuucaaagaacgcaacuuaaacgacacccgcuacguaaaccgcuuccuaugccaauucguagccgaccgcaugcgacucacggguaagggaaagaagcgagucuucgcauccaacggacaaauaacaaaccucuuacgcggguucuggggacuaaggaaaguacgcgccgaaaacgaucgccaccaugcccucgacgccguggucguagcaugcuccacugucgcaaugcaacaaaagauaacccgcuucguacgcuacaaggagaugaacgccuucgacggcaagacaauugacaaggaaacuggcgaagugcuucaccagaaaacacacuucccccaacccugggaguucuucgcacaagaaguaaugauacgcgucuucgguaaaccggacgggaaaccggaguucgaagaagcugacacauuggaaaaacuccgaacccuacuggcggaaaagcucagcagccggcccgaagccguacacgaauacgucaccccacucuucgugucucgggcgcccaacaggaagauguccggacaaggacacauggaaacgguaaaaucagcgaaacgacuggacgaaggcguauccguccuacgcgugccccucacacaacucaaacucaaggaccuagagaaaaugguaaaccgcgaacgagaacccaagcuauacgaggcccuaaaagcccgccuagaagcacacaaggacgacccugcaaaggcuuucgcugaacccuucuacaaauacgacaaagccggcaaccgaacccaacaaguaaaagcaguacgagucgaacaagugcagaaaacaggcguauggguccgaaaccauaacggaaucgcugacaacgcuacgaugguccgcgucgaugucuucgagaaaggcgacaaauacuaccuagucccaauauacucguggcaaguagcaaaaggaauccugccagaccgagccgucguacaaggcaaagacgaagaggauuggcaacugaucgacgauagcuucaacuucaaguucagccuccaccccaacgaccucguggaggugauaaccaagaaagcucguauguucggcuacuucgcguccugccaccggggaacgggcaacaucaacauacgcauucacgacuuagaccacaaaauagguaaaaacgggauacucgaagguaucggagugaaaacagcacucagcuuccaaaaauaccaaauagacgaacuaggcaaggagauaagaccaugcaggcucaaaaagagaccacccgugagauga

SEQ ID NO: 7187 - RNA, 4005 nt, Artificial Sequence
  Cas9 variant
augaagaagcccuacaccaucgggcuggacaucgggacaaacagcgugggcugggccguccucacggaccaguacgaccuggugaagcgcaagaugaagaucgccggggacuccgagaagaagcagaucaagaaaaacuucuggggcgugcggcuguucgacgaggggcagacggcggccgaccgccggauggcccgcaccgcucggaggcggaucgagcgccggcgcaaccggaucagcuaccuccagggcaucuucgccgaggagauguccaagaccgacgcgaacuucuucugccgccugagcgacuccuucuacgucgacaacgagaaacggaacagccgccacccguucuucgccacaaucgaggaggagguggaguaccacaagaacuaccccaccaucuaccaccuccgggaggagcuagugaacuccagcgagaaggccgaccugcgccuagucuaccucgcccuggcgcacaucaucaaguaccggggcaacuuccugaucgagggggcccucgacacccagaacaccuccguggacggcaucuacaagcaguucauccagacguauaaccagguguucgccagcgggaucgaagacggcucccugaagaagcuggaggacaacaaggacgucgccaagauccucguugagaaggugacccgcaaggagaagcuggagcggauccugaagcucuaccccggggagaaguccgccggcauguucgcgcaguucaucagccugaucgucggcagcaaggggaacuuccagaagcccuucgaccugaucgagaaguccgacaucgagugcgccaaggacagcuacgaggaggaccucgagagccugcuggcauugaucggcgacgaguacgccgagcuguucguggccgcuaagaacgccuacagcgccguuguauuguccagcaucaucaccguggccgagaccgagacgaacgccaagcucagcgcguccaugaucgaacgcuucgacacacacgaggaggaccugggggaguuaaaggccuucaucaagcuccaccucccgaagcacuacgaggagaucuucagcaacaccgagaaacacggcuacgccggcuacaucgacgggaagaccaagcaggccgacuucuacaaguacaugaagaugacgcuggagaacaucgagggcgccgacuacuucaucgcgaagaucgagaaggagaacuuccugcggaagcagcgcaccuucgacaacggggccauuccccaccagcugcaccuggaggagcucgaggccauccugcaccagcaggccaaguacuaccccuuccugaaggagaacuacgacaagaucaagucucucgugaccuuccgcauccccuacuucgucggcccgcuggcgaacgggcagucggaguucgccuggcugacccggaaggccgacggcgagauccgccccuggaacaucgaggagaagguggacuucggcaaguccgccguggacuucaucgagaagaugacgaacaaggacaccuaccucccgaaggagaacguccugcccaagcacagccugugcuaccagaaguaccucguguacaacgagcugaccaaggugcgguacaucaacgaccaggggaagaccuccuacuucagcggccaggagaaggagcagaucuucaacgaccuguucaagcagaagagaaaggucaagaagaaggaccucgagcuguuccugcggaacaugucccacguggagagcccgacgaucgaggggcuggaggacuccuucaacucuuccuacagcaccuaccacgaccuccugaaggucggcauuaagcaggagauccuggacaaccccguaaacaccgaaaugcucgaaaacaucgugaagaucuugaccgucuucgaggacaagcgcaugaucaaggagcagcugcagcaauucuccgacguccucgacggggugguccugaagaagcuggagcggcgccacuacacgggcuggggccggcucagcgccaagcugcugauggggauccgcgacaagcagucccaccucaccauccuggacuaccugaugaacgacgacggccucaaccggaaccugaugcagcugaucaacgacagcaaccucuccuucaagagcaucaucgagaaggagcaggucaccaccgcggacaaggacauccagagcaucguggccgaccuggccgggucccccgccaucaaaaagggcaucuugcagagccucaaaaucguggacgagcugguauccgugaugggguacccgccccagacgaucgucguggagauggcccgcgagaaccagaccaccggaaagggcaagaacaacagccggccucgcuacaagucccuggagaaggcgaucaaggaguucgggagccaaauccucaaggagcaccccaccgacaaccaggagcugaggaacaaccgccuguaccucuacuaccugcagaacggcaaggacauguacacggggcaggaccuggacauccacaaccucuccaacuacgacaucgaccacaucgugccccagucuuuuauaaccgacaacuccaucgacaaccugguccugaccagcuccgccggcaaccgggagaagggcgacgacgugccgccccucgagaucgugcgcaagcggaaagucuucugggagaagcuguaccaggggaaccugaugagcaagcgcaaguucgacuaccucaccaaggccgagcgcggcgggcugaccgaggcagacaaggcccgguucauccaccgccagcugguggagacgcggcagaucaccaagaacguggcgaacauccuccaccagcgcuuuaacuacgagaaggacgaccacggcaacaccaugaaacaaguccggaucgugaccuuaaaguccgcccuggugucucaguuccgcaagcaguuccagcucuauaagguccgggacgugaacgacuaccaccacgcacacgacgccuaccucaacgggguggucgcgaacacgcugcucaagguguacccccagcuggaacccgaguuuguguacggcgacuaccaccaguucgacugguucaaggccaacaaggccaccgccaagaagcaguucuacacgaacaucaugcuguucuucgcccagaaggaccgcaucaucgacgagaacggcgagauccucugggacaagaaguaccuggacacagucaagaagguuauguccuaccggcagaugaauaucgugaagaagacggagauccagaagggggaguucagcaaggcgaccaucaagccgaagggcaacuccuccaagcugaucccccgcaagaccaacugggaccccaugaaguacgggggccucgacagccccaacauggccuacgccgucgugaucgaguacgccaaggggaagaacaagcugguguucgagaagaagaucauccgggucaccaucauggagcgcaaggccuucgagaaggacgagaaggcguuccucgaggagcagggcuaccggcagccgaaggugcucgccaagcugcccaaauacacguuauacgagugcgaggagggccgccggcgcaugcucgccucugcuaacgaggcccagaaggggaaccagcagguccugcccaaccaccuggugacccuccugcaccacgcggccaacugcgaggugagcgacggcaagucccuggacuacaucgagagcaaccgcgagauguucgccgagcuccuggcccacguguccgaguucgcgaagcguuacacccuggccgaggccaaccucaacaagaucaaccagcuguucgagcagaacaaggagggagacaucaaagcaaucgcccagagcuucguagaccuaauggcguucaacgccaugggcgccccggccuccuuuaaguucuucgagaccacgaucgagcggaagcgcuacaacaaccucaaggagcugcugaacagcaccaucaucuaccaguccaucaccggguuguacgagagccggaagcgcuuggacgacuga

SEQ ID NO: 7188 - RNA, 4038 nt, Artificial Sequence; identical to SEQ ID NO: 1388
  Cas9 variant

SEQ ID NO: 7189 - RNA, 3171 nt, Artificial Sequence
  Cas9 variant
augcagaccacaaaccugagcuacauacucggccuagaccuaggaauugccucaguuggcugggccguaguagaaauaaacgaaaacgaagaccccaucggccuaaucgacgucggagugcgaauauucgaacgggcagaagugcccaaaaccggagaaagucucgcacuaucacgacggcucgcccgaucgacgcgccgccuaauucgcagacgugcacaccgccugcuccuagcaaaacgguuccucaaacgcgagggaauccucucgacaaucgaccuagaaaaaggccuccccaaccaagccugggagcuacggguagccggucucgagagacgccuaagcgcgauagaguggggagccguccuacuccaccucauaaaacaucgaggauaccuuaguaaacguaaaaacgagucacagacaaacaacaaagagcucggugcacuacucucaggcguagcccagaaccaccaacuccuacaaagcgaugauuaccgaacaccagcagaacucgcacucaaaaaguucgcgaaagaggaaggacacauccgcaaccaaagaggagcguacacgcacacuuucaaccgacucgaccuucuagcagagcuuaaccuguuguucgcacaacaacaucaguucggcaacccacauugcaaagaacacauucagcaauacaugaccgaacuccucauguggcaaaagcccgcccucucaggagaagccauccucaaaaugcugggcaaaugcacccaugagaaaaacgaguucaaagcagcaaagcacaccuacagcgccgaacguuucgucuggcucacuaaacucaacaacuuacgaauacucgaggacggggcugagcgggcucucaacgaagaggaacggcagcuccugaucaaccacccauacgaaaaauccaaacucacauacgcccaaguaagaaaacuacucggacuaucugaacaagcaaucuucaaacaccucagauacuccaaagaaaacgccgaauccgcuacauucauggaacucaaggccuggcacgccauacgcaaagcccuagaaaaccagggauuaaaagacacauggcaagaucucgccaagaaaccagaucuccuagacgaaaucggaacagccuuuucacuuuacaaaaccgacgaagacauccaacaauaccucaccaacaaagucccuaacagcgugaucaaugcccuccuagucucucuuaauuucgacaaauucauagaacugagccugaaaagucuucgaaaaauacugccccuaauggaacaaggcaaacgcuaugaccaagcaugccgagagauauacggccaccacuacggcgaggccaaccagaaaacaucacaacuacuccccgcaauccccgcacaagaaaucaggaaccccguaguccuaagaacacucagccaagcaaggaaaguaauaaacgcaaucauucgacaauacgggagccccgcgagaguccacauagaaaccggccgugaacucggaaagagcuucaaagagcgccgcgaaauucagaaacaacaggaagacaacagaacgaaacgagagucagcaguacaaaaguucaaggaacucuucagcgacuucucaagugaacccaaauccaaggacauacugaaauucaggcuauacgagcaacaacacgggaaaugucuauacuccgguaaagaaauaaacauucaccgccugaaugaaaaaggguacgucgagauagaccacgcacuccccuucucacgcaccugggacgacagcuucaacaauaagguccuaguccuagcgucggaaaaucaaaacaaagguaaccagacaccauacgaauggcuccaaggcaaaaucaacuccgaacgcuggaaaaacuucgucgcccugguacuaggaucccaaugcucagcagcgaagaaacaacgccuccuaacacaaguaauagacgacaacaaguuuauagaccgaaaccuaaacgacacccgcuauaucgcgagguuuuuaucaaacuacauacaagaaaaccuccuucuugucggcaaaaacaagaaaaacgucuucaccccaaacggacagaucacagcccuccuccgcagccgguggggccuaauaaaggcacgcgaaaacaauaauaggcaccacgcucucgaugccaucgucguagccugcgcaacacccucaaugcaacagaaaaucacccgcuucauaagauucaaggaagugcaccccuacaaaauagaaaaccgcuacgaaaugguagaccaagaaagcggcgagaucaucaguccccacuuccccgaacccugggccuacuuuagacaagaggucaacauucgcgucuucgacaaccacccagacacagugcugaaagaaaugcucccggaccggccgcaagcaaaccaucaauuuguccaaccgcuauucgucucccgagcuccgacgcgcaaaaugagcggccaaggacacauggaaaccaucaaguccgcaaaacgccuagcagaaggcauaagcguacuacgcaucccucuaacccagcuaaagcccaaccuccuagaaaacaugguaaacaaagaacgcgaacccgcacuguacgcgggccugaaagcacgucuagccgaguucaaccaagaucccgccaaggcauucgccacaccauucuacaaacaaggcggacaacaaguuaaagccauuagagucgaacaaguccaaaagaguggaguacucguccgcgaaaauaacggggucgcagacaacgcgagcaucguucggacggacguauucaucaagaacaacaaguucuuccuuguucccaucuacaccuggcagguagccaaaggcauccuccccaacaaagccauaguggcccacaaaaacgaggacgaaugggaagaaauggacgaaggcgcaaaauucaaauucucccuguuccccaacgaccucguggaacucaagacgaagaaagaauacuucuucggcuacuacaucggacucgaucgggccacagggaacauaagccugaaagagcaugacggagaaauaaguaaaggcaaagacggcguguacagggucggcgucaaacuggcgcuaaguuucgaaaaauaccaaguugacgagcuagguaaaaaucgccagaucugccggccacaacaacggcaacccgucagauga

SEQ ID NO: 7190 - RNA, 3249 nt, Artificial Sequence
  Cas9 variant
auggccgccuucaagccgaauccgaucaacuauauccugggccucgacauuggcaucgccagcguaggcugggccauggucgaaauagacgaagacgaaaacccgaucugccuaaucgaccugggcguacgcguauuugaacgcgccgaagucccaaaaacgggcgacucacucgccauggcucggcgacuagcccgcagcguacgccgacugacacgacgacgagcccaccgacuucuacgagcccgacgccuccuaaaacgcgaaggcguacuacaagcagcagauuucgaugaaaacgggcucauaaaaagccugcccaacacucccuggcaacuacgagccgccgcccucgaucgcaagcugacaccccucgaauggagcgcaguccuccuacaccucauaaaacaccgaggcuaccucucccagcguaaaaacgaaggagagaccgcugacaaggaacuaggcgcgcuccucaaaggaguagcggauaacgcacacgcacuccaaacaggcgacuuccgcacacccgccgaacuagcacugaacaaauucgaaaaagaaucaggccacauccggaaccaaagaggggacuacagccacaccuucucaagaaaggaccuacaagccgaacucauccuccuauucgaaaagcaaaaggaguucggcaacccacacguuuccggcggauuaaaagaaggcaucgaaacgcuccuaaugacgcagcggcccgcccucucaggugacgccguacaaaagaugcuagggcacugcaccuucgagccagccgaaccaaaggccgcgaaaaacaccuauacagcagaacgcuucaucuggcucacaaagcucaacaaccuccgaauccucgaacagggguccgagcggccccugacagacacagaacgcgccacccucauggacgaacccuaccgcaaaucgaaacuuaccuacgcccaagcgcguaagcugcucggccucgaagacaccgcauucuucaaagggcucagauacggcaaagacaacgcagaagcguccacccuaauggaaaugaaggcauaccacgcaaucagucgagcacuagagaaagagggccucaaagacaagaaaagucccuuaaacuuaagcccagagcugcaggacgaaauaggcaccgccuucucccuauuuaaaacagacgaagacaucaccggacggcugaaggacaggauacaaccagagauccucgaagcacuacucaagcacauauccuucgacaaauucgugcaaaucucacucaaagcacucagacgaauaguaccacucauggagcagggcaagcgauacgacgaggcaugcgcagagaucuauggcgaccacuacggcaagaaaaacaccgaggagaaaauauaccugcccccaauaccggccgacgaaaucaggaaccccguuguccuacgggcacugucacaggccagaaaaguuauaaacggcguuguccgacgcuauggaagcccagcacggauacacaucgaaaccgcaagagaagucggcaagagcuucaaagaccgcaaagaaauagaaaaacgccaggaagagaacagaaaggaccgagagaaagcagccgccaaauucagagaauacuuccccaacuucguuggcgaacccaagagcaaagacauccuaaaacuucgacuguacgagcaacaacacggaaaaugccucuacagcgggaaagaaauuaaccucggacgccuaaacgaaaaaggauacguagaaauugaccacgcgcuaccguucucaagaacuugggacgacagcuucaauaacaaagugcuagucuuaggcucugaaaaccaaaacaagggcaaccaaacgccguacgaauacuucaacggaaaagacaacucccgggaauggcaagaguucaaagcccgcgucgaaacaucccgcuucccgagauccaagaaacaaagaauacuccuccagaaauucgacgaagacggauucaaagaacgaaaccuuaacgauaccagauacgucaaccgcuuccucugccaauucguagcagaccgcaugcgccucacaggaaaaggcaaaaagcgaguuuucgccaguaacggacaaaucaccaacuugcuacgagguuucuggggacugcgaaaaguuagagccgaaaacgaucgccaucacgcccuggacgcgguuguggucgcaugcucgaccgucgccaugcaacagaagaucacccgcuucguccgauacaaagaaaugaacgcauucgacggcaaaacgaucgacaaagaaacaggggaaguccuccaccagaaaacucacuucccccaaccaugggaauuuuucgcccaagaaguaaugauccgagucuucggcaaaccagaugggaagcccgaguucgaagaagcagauacgccggaaaaacuaaggacccuccuggccgagaaacuaagcagccgccccgaagccguucaugaguacguaacccccuuguucguaagcagagcacccaaccgcaaaaugagcggacaagggcacauggaaaccgucaaaagugccaagcgacucgacgaagguguuagcguccuaagagucccccugacccaacuuaagcucaaagaucuggagaaaaugguuaacagagaacgcgaacccaagcuauaugaagcccugaaggcacgacucgaagcccacaaggacgacccggcuaaagccuucgccgaaccauucuacaaauacgacaaagccggaaaccgaacgcaacaagucaaagcgguacguguggaacaaguccagaaaacagggguguggguccgcaaucacaacggaaucgcagacaacgccaccauggucaggguugacguguucgaaaagggggacaaauacuacuuaguaccaauauacaguuggcaaguggccaaaggaauccuaccugacagagcaguaguacaagggaaggacgaagaagauuggcaacuuauagacgacucguucaacuucaaauucagccuccaccccaacgaccuaguagaagugaucaccaagaaagcccggauguuuggauacuucgcaagcugccacagaggaacaggaaacaucaauaucagaauacacgaccuagaccacaaaaucggcaaaaacggaauccucgaaggaaucggagucaaaacagcgcuuagcuuccagaaauaccagauugacgaacucggaaaagaaauccgcccgugccgccugaaaaagcguccucccguacgauga

SEQ ID NO: 7191 - RNA, 3255 nt, Artificial Sequence
  Cas9 variant
augaaauaccacguugggauagacguaggaacauucagcgucggccuagcagccauagaaguagacgacgccgguaugccaaucaaaacccucagucugguaucacacauucacgacucaggccuagaucccgacgagauaaaaucagcagugaccagguuagcaagcuccggaaucgccagaagaacacgacgccucuaccgccgcaaacgaagaaggcuccaacaacucgacaaauucauacaaagacaaggcuggccggugaucgaauuggaagauuacucagacccacucuaccccuggaagguaagagcagaacucgcagcauccuacauagcagacgaaaaagaacgcggcgaaaaacucuccguggcccucaggcacauagcacggcaccggggguggagaaaccccuacgccaaagugagcagccuauacuugccagacggcccaagcgaugcauucaaagcgauacgggaagagauaaaaagagcaucagggcagcccguccccgaaacagccacaguaggccaaauggucacccucugcgagcucggaacgcuuaaacuaagaggcgaagguggaguccuaagcgcccgacuacagcaaucggacuacgcccgcgaaauacaagaaaucugccgaaugcaggagaucggacaagaacuuuacaggaaaauaauagacgucgucuucgcagccgaaucgccaaaaggcucagcauccagcaggguaggcaaagacccgcuccagccgggcaagaacagagcacuuaaagcauccgacgcauuccagagguauagaauagccgcacuuauaggaaaccuucgagucagagucgauggugagaaaagaauauugagcgucgaagagaaaaaccucgucuuugaccaccucguaaaucuaacaccaaagaaggaaccagaauggguaacaauagccgaaauauuaggaauugaccggggccagcuuaucggcacggccacaaugaccgacgacggcgaacgcgccggugcuagaccaccgacccacgacacaaaccggucgauagugaacagcaggaucgcaccccuaguagauugguggaaaaccgcauccgcacucgagcaacacgcgaugguaaaagcacuuuccaacgcagaaguggacgacuucgacagccccgaaggcgccaaaguacaagcauucuucgcggaccuugacgacgacguccacgcgaaacucgacuccuuacaccuacccguaggccgggccgcauacucugaagacacccugguccgacugacacgacgaaugcuuucagacggcguggaccuuuauaccgcccgacuacaggaguucgggauagaaccguccuggacucccccuacaccccgaauaggagaaccaguaggaaauccagcaguagaccgaguccuaaagaccguaucaagauggcucgaauccgcaacaaagacauggggagcaccagaaagagucaucauagaacacgucagagaaggcuucguaaccgagaaaagagcccgagaaauggacggggacaugcgaaggagagcagccagaaacgccaaacuauuccaagaaaugcaagaaaaacuuaacguccaagguaaaccaagccgagcggauuuauggcgcuaccaauccguccaaagacagaacugccagugcgcauacugcggaucucccaucaccuucagcaacagcgaaauggaccacaucgucccgagggccggccaaggaagcacaaacacccgcgaaaacuuagucgcaguaugucaccgcugcaaccaguccaaagguaacacccccuucgcaaucugggccaaaaacacguccauagagggaguaucagugaaagaggccguagaacggaccaggcacuggguuaccgacaccggcaugcgaagcaccgauuucaagaaauucacaaaggccgucgucgagagauuccaaagagcaacgauggacgaagagauagacgcccgaucgauggaaucgguggccuggauggccaacgagcuaagaagucggguggcccaacacuucgccucucacggaaccacgguccgagucuaccgcgggagccuaaccgccgaggcgcggagggccaguggaauaucaggaaagcugaaguucuucgacggcgugggcaagagccggcuggacaggagacaucacgcaauagacgcagcagugauagccuucacuagcgacuaugucgcagaaacucuagcaguccgcagcaaccuuaaacaaagccaagcacaccggcaagaagcaccccaguggcgggaguucacaggaaaagacgccgaacaccgcgccgccuggaggguuuggugucagaaaauggaaaaauuaagugcacuccuaaccgaagaccuccgggacgaccggguuguagucauguccaauguacgacuccgccuaggcaacggcagcgcacacaaggaaacaauaggcaaacuaagcaaagucaaacucucuucgcagcuauccgucagcgacauagauaaagccucauccgaagcauuauggugcgcccucacacgcgaacccggauucgacccaaaggagggucuaccagccaauccagaaaggcacauacgagugaacggaacccacguauacgccggagacaacaucgggcuauuccccguuagcgccggaagcauagcacuacggggcgguuacgcagaacucggaagcucguuucaccacgcgcgaguuuacaaaaucacaucaggcaaaaagccagcauucgcgaugcugcgaguauacaccaucgaccuacuacccuacaggaaccaggaccuuuuuaguguggagcuaaaaccacaaaccauguccaugagacaagcggaaaagaaacuacgagacgcccuagcaacaggaaacgcagaauaccuaggguggcuuguaguagacgacgagcuaguaguagacaccagcaaaauagcaacagaccaaguaaaagcaguagaagcagagcucggaaccauacgacgguggagagucgacggauucuucagccccucaaaacuacggcuacgaccacuccaaaugagcaaggaaggaauaaagaaagaaagcgcgccggagcucucaaaaaucaucgaccggcccggcuggcuaccagcgguaaacaaacucuucagcgacggcaaugucacgguagucaggagagacagccuaggacgcguaagacucgaaagcacagcacaccucccagucaccuggaaaguacaguga

SEQ ID NO: 7192 - RNA, 2955 nt, Artificial Sequence
  Cas9 variant
auggcccgcauccucgccuucgacaucggcauaagcuccaucgggugggcguucagcgagaacgacgagcucaaagacugcggcgugcggaucuucaccaaggucgagaaccccaagaccggugagucccuggcccugccgcgccggcucgcccgcagcgcccggaagcgccuggcccggcgcaaggcgcggcugaaccaccucaagcaccugaucgccaacgaguucaagcugaacuacgaggacuaccagagcuucgacgagagccucgccaaggcuuacaagggcucacugaucucucccuacgagcugagauuccgggcgcucaaugaguuacuguccaagcaggacuucgcccgcgugauccuccacaucgccaagcggcgcggguacgacgacaucaagaacagcgacgacaaagagaagggcgccauccugaaggcgaucaaacaaaacgaggagaagcuggcuaacuaccaguccgugggcgaguaccucuacaaggaguacuuccagaaguucaaggagaacagcaaggaguucacgaacguccggaacaagaaggaguccuacgagcgcugcaucgcccagagcuuccugaaggacgagcugaagcucauauucaagaagcagcgggaguucggguucuccuucucaaagaaguucgaggaggaggugcuguccguggccuucuauaagcgcgcccugaaggacuucagccaccucgucggcaacugcuccuucuucaccgacgagaagcgggcccccaagaacagcccccuggcguucauguucguggcccugacgcguaucaucaaccuccugaauaaccugaagaacaccgagggaauccucuacacgaaggacgaccugaacgcccugcucaacgaggugcugaagaacggcacccugaccuacaagcagacgaagaagcuccugggguugagcgacgacuaugaguucaagggggagaagggcacguacuucaucgaguucaagaaguacaaggaguucaucaaggcccucggggagcacaaccucucccaggacgaccugaacgagaucgccaaggacaucacccucaucaaggacgagaucaagcugaagaaggcgcuggccaaguacgaccucaaccagaaccagaucgacagccuguccaagcuggaguucaaggaccaccucaacaucagcuucaaggcccugaagcuggucaccccgcugauguuagagggcaagaaguacgacgaggccugcaacgagcugaaccugaagguggccaucaacgaggacaagaaggacuuccuccccgcguucaacgagaccuacuacaaggacgaggugacgaaccccgucgugcugcgggccaucaaggaguacaggaaggugcugaacgcccuccugaagaaguacggcaagguccacaagaucaacaucgagcuggcccgcgaggugggcaagaaccacucccagcgggcgaagaucgagaaggagcagaacgagaacuacaaggccaaaaaggacgccgagcucgagugugagaagcugggccugaagaucaacagcaagaacauccucaagcugcgccuguucaaggagcagaaggaguucugcgccuacuccggggagaagauaaagaucagcgaccuccaggacgagaagaugcuggagaucgaccauaucuaccccuacucccggagcuucgacgacuccuacaugaacaaagugcuggucuucaccaagcagaaccaggaaaagcucaaccagacaccuuucgaagccuucggcaacgacagcgcgaaguggcagaagaucgaggugcuggccaagaaccugcccaccaagaagcagaagcgcauccucgacaagaacuacaaggacaaggagcagaagaacuucaaagaccggaaccugaacgacacgcgcuacaucgcccggcuggugcucaacuacaccaaggacuaccuggacuucuuaccccucuccgacgacgagaacaccaaacuaaacgacacccagaaggggagcaagguccauguggaggccaaguccggcaugcugacgagcgcccuccgccacaccuggggguucuccgcgaaggaccggaacaaccaccuccaccacgcgaucgacgccgugaucaucgccuacgccaacaacagcaucgucaaggcguucuccgacuucaagaaggagcaggagagcaacagcgcggagcuguacgccaagaagaucuccgagcuggacuacaagaacaagcgcaaguucuucgagcccuucagcggcuuccggcagaaggugcuggacaagaucgacgagaucuucguguccaagccggagcgcaagaagcccagcggcgcccugcacgaggagaccuuccggaaggaggaggaguucuaccaguccuacgggggcaaggaggggguacucaaggcgcuggagcugggcaagauccgcaaggugaacgggaagaucgucaagaacggcgacauguuccggguggacaucuucaagcacaagaagaccaacaaguucuacgccgugccuaucuacacaauggacuucgcccucaagguccugcccaacaaggccguggcccgcucgaagaagggcgagaucaaggacuggauccugauggacgagaacuacgaguucugcuucucccucuacaaggacagccugauccugauccagaccaaggacaugcaggagccggaauuuguguacuacaacgcguucaccucaagcacaguuucccucaucgugagcaagcacgacaacaaguucgagacgcuguccaagaaccagaagauccuguucaagaacgccaacgagaaggaggugaucgccaagagcaucgggauccagaaccucaaggucuucgagaaguacaucguguccgcccugggcgaggugaccaaggccgaguuccggcagcgcgaggacuucaagaaguga

SEQ ID NO: 7193 - RNA, 3366 nt, Artificial Sequence
  Cas9 variant
augagcgacuugguccucggcuuagacaucgggaucggcuccgucggggugggcauccugaacaaggugaccggggagaucauccacaagaacagccgcaucuucccggccgcccaggcggagaacaaccucguccggcgcaccaaccggcagggccgccggcuggcccgccggaagaagcaccgccgggugcgccugaaccgccucuucgaggaguccggccugaucacggacuucaccaagauuagcaucaaccugaacccguaccagcuccgggugaaggggcugaccgacgagcuguccaacgaggagcuguucaucgcccugaagaacauggucaagcaucggggcaucagcuaccuggacgacgccagcgacgacgggaacagcuccgugggcgacuacgcccagauugugaaggagaacagcaagcagcucgagaccaagacgcccgggcagauccagcuggaacgcuaccagaccuacggccagcuucggggcgacuucaccgucgagaaggacgggaagaagcaccgccucaucaacguguuccccaccuccgcguaccggagcgaggcccugcgcauccugcagacgcagcaggaguucaacccccagaucaccgacgaguucaucaaccgcuaccucgagauccugaccggcaagcgcaaguacuaucacgggccgggcaacgagaagucccggaccgacuacggccgcuaccgcacgucaggggagacccuggacaacaucuucggcauccucaucgggaagugcaccuucuaccccgacgaguuccgggcggccaaggcguccuacaccgcccaggaguucaaccugcugaacgaccucaacaaccugacggugcccaccgagaccaagaagcugagcaaggagcagaagaaccagaucaucaacuacgucaagaacgagaaggcuaugggccccgccaagcuguucaaguacaucgccaagcuccuguccugcgacgucgcggacaucaagggguaccgcaucgacaagagcggcaaggccgagauccacaccuucgaggccuaccggaagaugaagacgcucgagacccuggacaucgagcagauggaccgcgagacccuggacaagcucgccuacgugcugacccuaaacacggagcgggaaggcauacaggaggcccucgagcacgaguucgcggacggguccuucagucagaagcaagucgacgagcuggugcaguuccgcaaggccaauagcuccaucuucggcaagggguggcacaacuucagcgugaagcugaugauggagcucaucccggagcuguacgagaccuccgaggagcagaugaccauccugacacggcucggcaagcagaagacgaccagcuccagcaacaagaccaaguacaucgacgagaagcugcucaccgaggagaucuacaaccccgucguggccaaguccgugcgccaggccaucaagaucgucaacgccgcgauaaaggaguacggggacuucgacaacaucgugaucgagauggcccgagagaccaacgaggacgacgaaaagaaagcaauccagaagauccaaaaggccaacaaggacgagaaggacgccgcgaugcucaaggccgccaaucaauacaacggcaaggccgagcugccccacagcguguuccacggccacaagcagcuggcgaccaagauccgccuguggcaccagcagggggagcggugccucuacaccggcaagaccaucuccauccacgaccugaucaacaacagcaaccaguucgaggucgaccacauccugccccucuccaucacguucgacgacagccuugccaacaaggugcuggucuacgccaccgccaaccaggagaaggggcagcgcaccccguaccaggcccucgacucgauggacgacgcauggagcuuccgggagcugaaggccuucgugcgcgaguccaagacccugagcaauaagaagaaggaauaccuccugacggaggaagacauuuccaaguucgacgugcgcaagaaguucaucgagcgcaaucuggucgacacgcgguacgccucucgcguggugcucaacgcccugcaggagcacuuccgggcccacaagaucgacaccaagguuuccguggugcgcggccaguucaccagucagcugcgccggcacugggggaucgagaagacccgcgacacguaccaccaccacgcggucgaugcccuuaucaucgcagccagcucccagcugaaccuguggaagaagcagaagaacacccucgugagcuacuccgaggaccagcugcuagacaucgagaccggcgagcucaucagcgacgacgaguacaaggaguccguguucaaggcccccuaccagcacuuugucgacacccucaagagcaaggaguucgaggacuccauccuguucagcuaccagguggacuccaaguucaaccggaagaucagcgacgcgacgaucuacgccacccgccaggccaaggugggcaaggacaaggccgacgagaccuauguccucgggaaaaucaaggacaucuacacucaggacggcuacgaugcguucaugaagaucuacaagaaggacaaguccaaguuccugauguaccgccacgacccccagacguucgagaaggugaucgagcccauccuggagaacuacccgaacaagcagaucaacgagaaggggaaggaagugcccugcaaccccuuccucaaguauaaggaggagcacggcuacauccgcaaguacagcaagaagggcaacgggcccgagaucaagucccugaaguacuacgacagcaagcugggcaaccacaucgacaucaccccgaaagacuccaacaacaagguagugcuccagagcgugucccccuggcgggcggacgucuacuucaacaaaaccaccgggaaguacgagauccugggccugaaguacgccgaccuccaguucgagaaggggacgggcaccuacaagaucagucaggagaaguacaacgacaucaagaagaaggagggcguggacagcgacuccgaguucaaauucacccuguacaagaacgaccugcuccuggugaaagacacugagacgaaggagcagcaacuguuccgcuuccucagccggaccaugccuaagcagaagcacuacgucgagcugaagcccuacgacaagcagaaguucgagggcggggaggcccugaucaaggugcucgggaacguggccaacuccggccagugcaagaaggggcugggcaagagcaacaucuccaucuacaagguccgcacagacgugcugggcaaccagcacaucaucaagaacgagggggacaagccgaaacucgacuucuga

SEQ ID NO: 7194 - RNA, 2556 nt, Artificial Sequence
  Cas9 variant
augaccaacggcaagauucuggggcucgacaucggcguggccagcgucggggugggcaucaucgaggccaagaccgggaaggugauccacgcaaacucccgccuguucagcgccgccaacgccgagaacaacgccgagcggcggggcuuccggggcgcgcgccggcugacgcgccggaagaagcaccgcgucaagcgggugagagaccucuucgagaaguacgacauccugaccgacuuccggaaccugaaccucaaccccuacgagcugcgcgugaaggggcugaccgagcagcucaccaaugaggagcuguucgccgcccugcggacgaucgccaagcgccggggcaucuccuaccuagacgacgcagaggacgacagcaccggguccagcgacuacgccaaguccaucgacgagaaccgccggcugcucaagagcaugacccccggccagauccaacuggagcgccuggagaaguacgggcagcugcggggcaacuucacagucuacgacgagaacggcgaggcccaccgccuaaucaacguguucuccacgagcgacuacaagaacgaggcccggaagauccuggagacccaguccaacuacaacaagcagaucaccgacgaguuuaucgaagacuacaucgagauccugacccagaagcgcaaguacuaccacgggcccggcaacgaaaagucccgcacggauuacgggcgguuccgcaccgacggcaccacccucgagaacauuuuuggcauccugaucgggaagugcagcuucuaccccgaggaguaccgggccagcaaggcguccuacacggcccaggaguucaacuuccugaacgaccucaauaaccugaaggugcccaccgagaccggcaagcugagcaccgagcagaaggaguaccucgucaacuucgccaagaacuccaagacgcugggggccagcaagcugcucaaggagaucgccaagcugguggacggcgacgugaaggacaucuccggguaccgcgaggacagcaagggcaagccggaccugcacaccuucgagcccuaccggaaguugaaauucaaccugaccaccgucgacaucgacaaccugagccgcgacauccucgacaagcuggcggacaucuuaacgcucaacaccgagcgggaggggaucgaggacgccauuaaccagaaccugcccgagcaguucaccaaggagcagaucuccgaaaucguucagauccgcaagagccaguccagcgccuucaacaagggguggcacuccuucagcgccaagcugaugaacgagcuuauccccgagcuguacgccaccuccgaggaacagaugacgauccugacccggcucgagaaguucaaggcgacuaagaaguccagcaagaacaccaagacgaucgacgagaaggagauaaccgacgaaaucuacaacccgguggucgccaagagcgugcgccagaccaucaagaucaucaacgccgccgugaagaaguacggcgacuucgacaagaucgucaucgagaugccccgggacaagaacgccgacgacgagaagaaguucaucgacaagaagaacaaggagaacaagaaggagaaggacgacucccugaagcgcgcggcauaccuguacaacgggaccgacaagcuccccgacgacguguuccacggcaacaagcaauuggccacgaagauccggcuuugguaccagcagggggagagaugccuguacagcggcaagcccauccucauccaggaccuggugcacaauuccaacaacuucgagaucgaccauauccugccgcucagccuguccuucgacgacagccuggccaacaagguccucguguacgcgugggccaaccaggagaaggagcagaagacccccuaccaggugauagacuccauggacgccgccuggagcuuccgggaaaugaaggauuauguccugaagcagaagggcaucgggaagaagaagcgcgaguaccugcucaccaccgagaacaucgacaaaaucgaggugaaaaagaaguucaucgaacggaaccuggucgacacccgcuacgccucccggguggugcucaacagccuccagacggcgcugaaagagcugggaaaggauaccaaagucagcguggugcgcgggcaguucaccucccagcuccgccggaaguggaagaucgauaagagccgcgagaccuaccaccaccacgccgucgacgcccugaucaucgccgccuccagccagcugaagcucuggcagaagcacgagaaccugauguucgagaacuacggcgagaaccagguggugaacaaggagacgggcgagauccuguccaucagcgacgacgaauacaaggaguccguauuccagccgcccuaccagggcuucgugaacaccaucagcuccaaggcguucgaggacgaaauccucuucagcuaccagguggauuccaaguucaaccggaaggucagcgacgccaccaucuacuccacccgcaaggccaagcugggcaaggacaagaaggaggagacguacgugcuggggaaguga

SEQ ID NO: 7195 - RNA, 2598 nt, Artificial Sequence
  Cas9 variant
augagacacaagauaggccuggacauaggaaucaccuccguggggugggcuguaaucaaccuugacaucccacgcauugaagaccucggaguccgcauauucgaccgcgcggaaaacccccaaaccggcgaaucucucgcacuacccagacgccuggcccgaagcgcgcgacgacgccuaagacgccgaaaacacagacuagaacguauccgacgacuccuaaucagagaaggcauacugacaaaagaggaacucgauaaacuguuugaggaaaagcaugagaucgaugucuggcaauuacgaguugaggcacucgaccgcaaacuuaacaacgacgaacuagcaaggguccuacuacaccuagccaaacgaagaggcuuuaaaucaaaccgcaagagcgaacguaacaacaaagagaacucaacaaugcucaaacacauagaagaaaaccgagcacugcugagcggauacagaaccgucgccgagaugaucgucaaagauccgaaauuugccuuccacaaacgcaauaaaggcgaaaauuacacuaacaccaucgcacgagacgaccuagaacgcgagaucaaacuuaucuucacaaaacagcgggaauacgggaacaucgucugcaccgagaccuucgaaaacgaauauaucaugauaugggcaucgcagcgacccuuugccuccaagaacgacauagagaagaaaguaggguucugcacauucgaaccgaaagagaaaagggcaccaaaagccacauacacauuccaaucuuucgucgcaugggagcacauaaacaaacuccgccugguuuaccccaccggcacccgcggccucaccgacgaagaacgacgacuccucuacaaacaagccuuucauaaaaacaaaauaacuuaccacgauauccggacacuccugcaccuacccgacgacaccuacuucaaaggaaucguauacgaccgcggggcaccacucaaacaauccgaaacuauccgcuuccuggaacuugacgcuuaccaccagauucgcaaggccguugacaaggucuacgguaagggcaaaagcuccagcuuccucccgaucgacuucgacacauuuggguacgcauugacacucuucaaagaugacgcugacauccgguccuacuuacgcaacgaauacgaacagaauggcaaacguaugcccaaucucgccaacaaggucuaugacaacgagccgaucgaggaacuacuuaaccuauccuucacaaaauucggccaucuuucucuaaaagcacugcgcaacauccucccauauauggagcaaggcgaaguguacucggucgcgugcgaaagggcuggauacacauucaccggacccaaaaagaaacagaaaacccuccuacuaccaaauauucccccuaucgccaacccaguagucaugcgcgcacuaacacaagcacgcaaaguuguuaacgcgaucauaaagaaauacggaagcccugucagcauccacaucgaacucgcacgcgaucuuucacaaacguucgacgaacgccgaaaaacaaaacgcgaacaagacgaaaaccgcaagaaaaacgaaaccgcgauccgacaacucauggaauacggccuaaccaucaaccccaccggccacgacaucgucaaauucaaacucuggucagaacaaaacggcagaugcgcauacucccuacaacccaucgaaaucgaacgccuccuagaaccaggauacguagaaguagaccacguuauucccuacagcagaucccuagaugacagcuacacaaacaaaguccucguccucaccaaagaaaaccgugaaaaaggaaacagaauacccgcagaauaccucggcgucggcaccgaacgcuggcaacaauucaaaacauuuguccucaccaacaaacaauucuccaaaaagaaaagagaccgacuccuacgccuccacuacgacgaaaacgaagaagccgaauggaaaaacagaaaccuaaacgacacacgcuacaucucacgcuucuucgccaacuucauccgcgaacaccuaaaauuugcagaaucagacgacaaacaaaaaguauacacagucaacggccgcgugaccgcacaccuccgauccagaugggauuucaacaaaaaccgcgaagaaucagaccuccaccacgcaguagacgccgccaucgucgcauguacgagcccgagcgacaucgcgcgagugacagccuucuaccaacgccgagaacaaugcaaggaauccgcgaagaaagcagaaccacacuucccccaacccuggccccacuucgccgacgaacuacgcgcacgccuaagcaaaaaucccaaagagucaaucaaagcucuuaaccuaggaaacuaugacgaccagaaacuagaaagccugcaacccguauuuguaucacgcaugccgaagcgaagcguaaccggugcagcacaccaagaaacccuccggcgcuacaucggaauagacgaacguucgggcaagauccaaaccgucguaaaaacaaaacuaagcgaaauaaaacucgacgaaaccggacacuucccgauguacggaaaagaguccgacccacccgccucagcguga

SEQ ID NO: 7196 - RNA, 2886 nt, Artificial Sequence
  Cas9 variant
auggcccgcauccuggccuucgacaucggcauuagcuccaucgggugggcguucagcgagaacgacgagcucaaggauugcggcgugcguaucuucaccaaggcugagaaccccaagaccggggagucccuggccuuaccgcgacggcucgcccgcagcgcccggaagcgccuggcgagacgcaaggccaggcugaaccaccucaagcaccuuaucgccaaugaguucaaauugaacuacgaggacuaccaguccuucgacgagagccucgccaaggcguacaaaggaucccugaucagccccuacgagcugcgauuccgggcccucaacgagcuguuguccaagcaggacuucgcccgcgucaucuugcacaucgccaagcgucgcggguacgaugacaucaagaacaacggcgacgaggaaaagggcaagauccugaaggccaucaagcaaaacgaggagaaacuggugaacuaccagagcgugggggaguacuuguauaaggaguacuuucagaaguucaaggagaacagcaaggaguucauuaacguccggaacaagaaggagagcuacgagcgcugcaucacgcaauccuuccugaaguacgagcugaagcucaucuuccagaagcagcgggaguucggguucagcuucuccaagaaguucgaggaggaggugcugagcguggcguucuacaagcgcgcgcugaaggacuucucccaccucguggggaacugcucguucuucuccgacgagaaaagagcccccaagaacagcccgcuggccuucauguucguggcccugacccgcaucaucaaccuccugaacaaccugaagaacaccgaagguauccucuauaccaaggacgaccuaaacgcgcugcucaacgaagugcugaagaacgggacgcugaccuacaagcagacaaagaaacuccugggccugagcgacgacuacgaguucaagggcgagaaggggacuuacuuuaucgaguucaagaaguacaaggaguucaucaaggcccucggcgagcacaaccugucccaggacgaccugaacgagaucgcaaaggacauuacgcucaucaaggacgagauaaagcugaagaaggcccuggccaaguacgaccucaaccagaaucagauugacagccuguccaagcuggaguuuaaggaccaccucaauaucggguucaaggcgcugaagcugauaacgccgcugaugcucgagggcaagaaauacgacgaggccugcaacgagcugaaccugaaggucgccaucaacgaggauaagaaggacuuccuacccgccuucaaugagaccuacuacaaggacgaggugaccaaccccgugguccuacgggcuaucaaggaguaucgcaaggugcugaacgcgcuccugaagaaguacggcaaggugcacaagaucaacaucgaacuggcccgcgaagucgggaagaaccacagccagcgggccaagaucgagaaggaacagaacgagaauuacaaggccaagaaggacgcggagcucgaaugcgagaagcugggccugaagauuaacuccaagaacauccucaagcugcgccuguucaaggagcagaaggaguucugcgccuacagcggagagaagaucaagcucuccgaccugcaggacgagaagaugcuggagaucgaucacaucuaccccuacagccgguccuucgacgacagcuacaugaacaaggugcucguguucacgaaacagaaccaggagaaacugaacaagaccccguucgaggccuucggcaacgacaaugucaaauggcaaaagaucgaggugcuggccaaaaaccuccccgagaagaagcagaagcgcauccuggacaagaacuacaaggacaaggaacagaaagacuucaaggaccggaaccugaacgacacccgcuacauagcccggcucguguuaaacuacacgaaggacuaccuggacuuccucccccuguccgacgacgagaacacgaagcugaagggcagcaagguccacguggaggcgaaguccggcaugcucaccagcgcccugcgccacaccuggggcuucuccacaaaggaucggaacaaccaucuccaccacgccaucgacgccgccaucaucgcguacgccaacaacagcaucgugaaggacuucuccgacuucaagaaggagcaggagaguaacuccgccgaacuguacgccaagaagaucagcgagcuggacuacaagaacaagcgcaaguucuuugagcccuucuccggguuccggcaaaaaguccuggacaagaucgacgagaucuucguguccaagccggagcgcaagaagcccagcggcgcucuacacgaggagacguuucggaaggaagaagaguucuaccaauccuacggaggcaaggagggggugcugaaggcgcuggagcucggcaagauucgcaaggugaauggcaagaucgugaagaacggggacauguuccgcgucgacaucuucaagcacaagaagacgaacaaguucuacgccgugcccaucuacaccauggacuucgcccugaaggugcugccaaacaaggccgucgcgcgcagcaagaagggcgaaaucaaggacuggaucuugauggacgagaacuacgaguucugcuucucucuguacaaggacagccugauccuaauccagaccaaagacaugcaggagccggagcugguguauuucaacgccuucacguccagcaccguaucacugaucgucagcaagcacgacaacaaguucgagacgcucuccaagaaccugaagguguucgagaaguacaucgucagcgcccugggggaggucaccaaggccgaguuccggcagcgcgaggacuucaagaaugagcuccgguga

SEQ ID NO: 7197 - RNA, 2955 nt, Artificial Sequence; identical to SEQ ID NO: 1397
  Cas9 variant

SEQ ID NO: 7198 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcgcugccgcgccggcucgcccgcagcgcccggaagcgccuggcgcggcgcaaggcccggcugaaccgccucaagcaccugaucgccaaugaguucaagcugaacuacgaggacuaccagucuuucgacgagagcuuagccaaggcguacaagggcucccugaucagccccuacgagcugcgguuccgcgcccucaacgagcugcuguccaagcaggacuucgcccgggucauccuccacaucgcaaagcgccggggguacgacgacaucaagaacagcgacgacaaggagaagggcgccauccugaaggcgaucaagcagaacgaggagaagcuggccaacuaccagucggugggcgaguaccucuacaaggaguacuuccaaaaguucaaggagaacagcaaggaguucacgaacgugcguaacaagaaggagucauaugagcggugcaucgcccagagcuucuuaaaggacgagcugaagcucaucuucaagaagcagcgcgaguucgguuucuccuucagcaagaaguucgaggaggagguccuguccguggcguucuacaagcgggcccugaaggacuucagccaccucgugggaaacugcuccuucuucaccgacgagaaacgcgcucccaagaacagcccccuggccuucauguucgucgcccugacccggauuaucaaccuccugaacaaccugaagaacaccgaggggauccucuacacgaaggacgaccugaacgcccugcucaaugaguuccugaagaacggcacccugaccuacaagcagaccaagaagcuccugggguuaagcgacgacuacgaguucaagggcgagaagggcacguacuucaucgaguucaagaaguacaaagaguucaucaaagcucucggggagcacaaccugucccaggacgaccugaacgagaucgcgaaggacaucaccuuaaucaaggacgagaucaagcugaagaaggcccuggccaaguacgaccucaaccaaaaccagaucgacucgcuguccaagcuggaguucaaggaccaccucaacaucagcuucaaggcccugaagcugaucaccccgcugaugcucgaaggcaagaaguacgacgaggccugcaaugagcugaaccugaagguggcgaucaacgaggacaagaaggacuuccuccccgccuucaacgaaaccuacuacaaggacgaggugacgaaccccgucgugcugcgcgccaucaaggaguaccgcaaggugcugaacgcccuccugaagaaguacgggaagguccacaagaucaacaucgagcuggcgagagaggugggcaagaacuacucccagcgcgccaagaucgagaaggagcagaacgagaacuacaaggccaaaaaggacgccgagcucgagugcgagaaguuaggccuuaagaucaacagcaagaacauccucaagcugcggcuguucaaggagcaaaaggaguucugcgccuacuccggggagaagauaaaaaucagcgaucuccaggacgaaaagaugcuggagaucgaccacaucuaccccuacucccgcaguuucgacgacuccuacaugaacaaggugcuggucuucaccaagcagaaccaggagaagcucaaccagaccccguucgaggcguucggcaacgacagcgccaaguggcagaagaucgaagugcucgccaagaaccugcccaccaagaagcagaagcggauccucgauaagaacuacaaggacaaggagcagaaagacuucaaggaccgcaaccugaacgacacgcgguacaucgcccgccuggugcucaacuacaccaaggacuaccuggacuuccugccccucuccgacgacgagaacaccaagcuaaacgacacccacaaggggagcaaaguccacguggaggccaaguccggcaugcugacgagcgcgcuccggcacaccuggggguucuccaccaaggaccgcaacaaucaccuccggcacgccaucgaugccgugaucaucgccuacgccaacaacagcaucgucaaggcguucuccgacuucaagaaggagcaagagagcaacagcgccgagcuguacgccaagaagaucucagagcuggacuacaagaacaagcgcaaguucuucgagcccuucagcggcuuccggcagaaggugcuggacaagaucgacgagaucuucguguccaagccggagcgcaagaagccgagcggcgcccugcaugaggaaaccuuccggaaggaggaggaguucuaccaguccuacgggggcaaggaggggguccucaaggcgcuggagcugggcaagauccgcaaggugaacgggaagaucgucaagaacggcgacauguuccggguggacaucuucaagcacaagaagacaaacaaguucuacgccgugcccaucuacaccauggacuucgccuuaaagguccugcccaacaaggccguggcccgcagcaagaagggcgaaaucaaggacuggauccugauggacgagaacuacgaguucugcuucucccucuacaaggacagccugauccugauccagaccaaggauaugcaggagccggaguucguguacuacaacgcguucaccuccagcacggucucccucaucguuagcaagcacgacaacaaguucgagacccuguccaagaaccagaagauccuguucaagaacgccaacgagaaggaggugaucgccaagagcaucgggauccagaaccucaaggucuucgagaaauacaucguguccgcccugggcgaggugaccaaggccgaguuccggcagcgugaggacuuuaagaaguga

SEQ ID NO: 7199 - RNA, 2955 nt, Artificial Sequence; identical to SEQ ID NO: 1399
  Cas9 variant

SEQ ID NO: 7200 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggaguccuuagcccugccgcgccggcucgcccgcagcgcccggaagcgccuggcgcggcgcaaggcccggcugaaccaccucaagcaccugaucgccaacgaguucaagcugaacuacgaggacuaccaauccuucgacgagagccucgcaaaagcguacaagggaucccugauuagcccauacgagcugcgcuuccgggcccucaacgagcugcuguccaaacaggacuucgcccgcgucauccuccacaucgccaagcggcgcggguacgacgacaucaagaauagcgacgacaaggagaagggcgccauucugaaggcgaucaagcagaacgaggagaagcuggccaacuaccaguccguaggcgaguaccucuacaaggaguacuuccagaaguucaaggaaaacagcaaggaguucacgaacgugcggaacaagaaggaguccuacgagcgcugcaucgcccagagcuuccuaaaggacgagcugaagcucaucuucaagaagcagcgggaguucggguuuuccuucagcaagaaguucgaggaggagguccuguccguggccuucuacaagcgcgcccugaaggacuucagccaccucguuggcaacugcuccuucuucaccgacgagaagcgggcgcccaagaacagcccccuggccuucauguucgucgcccugacgcgcaucaucaaccucuuaaacaaccugaaaaacaccgaggggauccucuacacgaaggacgaccugaacgcccugcucaacgaggugcugaagaacggcacccugaccuacaagcagaccaagaagcuccuggggcugagcgacgauuacgaguucaagggcgagaagggcacguacuucaucgaguucaagaaguacaaggaguucaucaaggcccucggggaucacucccugagccaggacgacuuaaacgagaucgcgaaggacaucacccucauuaaggacgagaucaaacugaagaaagcccuugccaaguacgaccucaaccagaaccagaucgacucccugagcaaacuggaguucaaggaccaccucaacaucuccuucaaggcccugaagcugaucaccccgcugaugcucgaaggcaagaaguacgacgaggccugcaacgagcugaaccugaagguggcgaucaacgaggacaagaaggacuuccuccccgccuucaacgagaccuacuacaaggacgaggucacgaaccccguggugcugcgggccaucaaggaguaccgcaaaaucuuaaacgcccuccucaagaaguacgggaagguccacaagaucaacaucgagcuggcgcgcgaggugggcaagaaccauagccagcgggccaagaucgagaaggagcagaacgagaacuacaaggccaagaaggacgccgagaucgagugcgagaagcucggccugaagaucaacucgaagaauauccugaagcuccgccuguuuaaggagcagaaggaguucugcgccuacagcggggagaagaucaagcuguccgaccuccaggacgagaagaugcuggagaucgaccacaucuaccccuacagccgguccuucgacgacagcuacaugaacaaggugcuggucuuuaccaagcagaaccaggagaaacucaacaagaccccguucgaggcguucggcaacgacuccaccaaguggcagaagaucgaagugcuggccaagaaccugcccgagaagaagcagaagcgcauccucgacaagaacuacaaggacaaggagcagaaagacuuuaaggaccggaaccugaacgacacgcgcuacaucgcccggcuggugcucaacuacaccaaggacuaccuggacuuccugccccucagcgacgacgagaacacaaagcugaacgacacccagaagggguccaagguccacgucgaggccaagagcggcaugcugacguccgcccucaggcacaccugggguuucagcgcgaaggacagaaauaaccaccuccaccacgccaucgacgccgccaucaucgcguacgcgaacaacuccaucgugaaggccuuuagcgacuucaagaaggagcaggagagcaacuccgucgagcuguacgccaagaagaucagcgagcuggacuacaagaacaagcgcaaguucuucgagcccuucucagguuuccggcagaaggugcuggacaagaucgacgagaucuucgugagcaagccggagcgcaagaagccguccggcgcccugcacgaggagaccuuccggaaggaggaggaguucuaccaaagcuacgggggcaaggaggggguccucaaggcgcuggagcugggcaagauucgcaaggugaaugggaagaucgucaagaacggcgacauguuccggguggacaucuucaagcacaagaagacaaacaaguucuacgccgugcccaucuacacgauggacuucgccuugaaaguccugcccaacaaggccguggcccgcuccaagaaaggcgagaucaaggacuggauccugauggacgagaacuacgaguucugcuucagccucuacaaggacucccugauccugauccagaccaaggacaugcaggagccggagcucguguacuucaacgcguucaccagcuccaccgucagccugaucguguccaagcacgacaacaaguucgagacgcugagcaagaaccagaagauccucuucaagaacgccaacgagaaggaagugaucgccaaguccaucgggauccagaaccugaaggucuucgagaaguacaucgugagcgcccugggcgagguuaccaaggccgaguuccggcagcgagaggacuucaagaaguga

SEQ ID NO: 7201 - RNA, 2955 nt, Artificial Sequence; identical to SEQ ID NO: 1401
  Cas9 variant

SEQ ID NO: 7202 - RNA, 2955 nt, Artificial Sequence
  Cas9 variant
auggcacgcaucuuggccuucgacaucggcaucagcuccaucgggugggcguucagcgagaacgacgagcuaaaggacugcggcgugcggaucuucaccaaggccgagaaccccaagaccggggagucccuggcccugccgcgccggcucgcgcgcagcgcccggaagcgccuggcgcgccgcaaggcccggcuuaaccaccucaagcaccugaucgccaacgaguucaagcugaacuacgaggacuaccaguccuucgacgagagccucgccaaggcguacaagggcucccugauuagccccuacgagcugcgcuuccgggcccucaaugagcugcuguccaagcaggacuucgcccgcgucauccuccacaucgccaagcggcgcggguacgacgacaucaagaacagcgacgacaaggagaagggcgccauucugaaggcgaucaagcaaaacgaggagaagcuggccaacuaccaguccgugggcgaguaccucuauaaggaguacuuccagaaguucaaggagaacagcaaggaguucaccaacgugcggaacaaaaaggaguccuacgagcgcugcaucgcccagagcuuccugaaggacgagcugaagcucaucuucaagaaacagcgggaguucggguucuccuucucgaaaaaguucgaggaggagguccuguccguggccuucuacaagcgcgcccucaaggacuucagccaccucgugggaaacugcuccuucuucaccgacgagaagcgggcgcccaagaacagcccccuggccuucauguuuguggcccugacccgcaucaucaaccuccugaacaaccugaagaacaccgagggcauucucuacacgaaggacgaccucaacgcccugcucaacgaagugcugaaaaacggcacccugacuuacaagcagaccaagaagcuccuggggcugagcgacgacuacgaguucaagggcgagaagggcacguacuucaucgaguucaagaaguacaaggaguuuaucaaggcccucggggaccacucccugagccaggacgaccugaacgagaucgcgaaggacaucacccucaucaaggacgagaucaagcugaagaaggcccuggccaaguacgaccucaaccagaaccagaucgacucccugagcaagcuggaguucaaggaccaccucaacaucuccuucaaggccuugaagcugaucaccccgcugaugcucgagggcaagaaguacgacgaggccugcaacgagcugaaccugaaaguggcgaucaacgaggacaagaaagacuuccuccccgccuucaacgagaccuacuauaaggacgaggucacgaaccccguggugcugcgggccaucaaggaauaccgcaagguucugaacgcccuccugaagaaguacgggaaggugcacaagaucaacaucgagcuggcgcgcgaggugggcaagaacuacagccagcgggccaagaucgagaaggagcagaacgagaacuacaaggccaaaaaggacgccgagcucgagugcgagaaacugggccugaagaucaacucaaagaacauccucaagcugcgccuguucaaggagcagaaggaguucugcgcuuauagcggggagaagaucaaaaucuccgaccuccaggacgagaagaugcuggagaucgaccacaucuaccccuacagccgguccuucgaugacuucuacaugaacaagguccugguguucaccaagcagaaccaggagaagcucaaccagaccccguucgaggcguucggcaacgauagcgccaaguggcagaagaucgaggugcuggccaagaaccugcccaccaagaagcagaagcgcauccucgacaagaacuacaaggacaaggagcagaaggacuucaaggaccggaaccugaacgacacgcgcuacaucgcccggcugguccucaacuacaccaaggacuaccuggacuuccugccccucuccgacgacgagaacaccaagcugaacgacacccagaaggggagcaaggugcacgucgaggccaaguccggcaugcugacgagcgcgcuccgccacaccuggggguucuccgccaaggaccggaacaaccaccuccaccacgccaucgacgccgucaucaucgccuacgcgaacaacagcaucgugaaggccuucuccgacuucaagaaggagcaagaaagcaacagcgccgagcuguacgccaagaagaucuccgagcuggacuacaagaacaagcgcaaguucuucgagcccuucagcggcuuccggcagaaggugcuggacaagaucgacgagaucuucgucuccaagccggagcgcaagaagcccagcggcgcucugcacgaggaaaccuuccggaaggaggaggaguucuaccaguccuacgggggcaaggaggggguccucaaggcccuggagcugggcaagauccgcaaggucaaugggaagaucgugaagaacggcgacauguuucggguggacaucuucaagcacaagaagacgaacaaguucuacgccguccccaucuacacgauggacuucgcccuaaaggugcugcccaacaaggccguggcgcgcagcaagaagggcgagaucaaggacuggauccugauggacgagaacuacgaguucugcuucucccucuacaaggacagccugauccugauccagaccaaggacaugcaggagccggaguucgucuacuacaacgccuucaccuccagcaccgugucccucaucguaagcaagcacgacaacaaguucgagacgcuguccaagaaccagaagauccuguucaagaacgccaacgagaaggaggucaucgcgaaaagcaucgggauccagaaccucaagguguucgagaaguacaucguguccgcccugggcgaggucacuaaggcggaguuccggcagcgcgaagacuucaagaaguga

SEQ ID NO: 7203 - RNA, 2955 nt, Artificial Sequence; identical to SEQ ID NO: 1403
  Cas9 variant

SEQ ID NO: 7204 - RNA, 2955 nt, Artificial Sequence
  Cas9 variant
auggugcgcauacuggcguuugacaucggcaucagcuccaucgggugggccuucagcgagaacgacgaacucaaggauugcggcguccggaucuucacuaagguggaaaaccccaagaccggggagucccuggcgcuaccgcgucggcucgcccgcagcgcccggaagcgccuggcccggcgcaaggcccggcugaaccaccucaagcaccugaucgcgaacgaguucaagcugaacuacgaagacuaccaguccuucgacgaaagccucgccaaggccuacaagggcucccugaucagcccauacgagcugcgcuuccgggcccucaacgagcuucuguccaagcaagauuucgcgcgcgucauccuccauaucgccaagcggcgcggguacgacgacaucaagaacagcgacgacaaggagaaaggcgccauccugaaggccaucaagcagaacgaggagaaguuagccaacuaccagucagucggcgaguaccucuacaaggaguacuuccagaaguucaaggagaacucuaaggaguucacgaacgugcggaacaagaaggaguccuacgagcgcugcaucgcacagagcuuucugaaggacgagcugaagcucauauucaagaagcagcgggaguucggguucuccuucagcaagaaguucgaggaggaagugcuguccgucgccuucuacaagcgcgcccugaaggacuucagccaccucgugggcaacugcaguuucuucacggacgagaagcgggcccccaagaacagcccccuggccuucauguucguggcgcugacccgcaucaucaaccuccugaacaaccugaagaacacugaggggauccucuacacgaaagacgaccugaacgcccugcucaacgagguccugaagaacggcacccugaccuacaagcagaccaagaagcuacuugggcugagcgacgacuacgaguucaaaggcgagaaggguacguacuuuaucgaguucaagaaguacaaggaguucaucaaggcccucggggagcacaaccugucccaggacgacuuaaacgagaucgccaaggacaucacccucaucaaggacgagaucaagcugaagaaggcccuggcgaaguacgaccucaaccagaaccagaucgacagccuguccaagcuggaguucaaggaccaccucaacaucagcuucaaggcccugaagcugaucaccccacugaugcucgaaggcaagaaauacgacgaggccugcaacgagcugaauuugaagguggccaucaacgaggacaagaaggacuuccuccccgccuucaacgagaccuacuacaaggacgaggugacgaaccccgucguccugcgggcgaucaaggaguaccgcaaggugcugaacgcucuccugaagaaguacgggaagguccacaagaucaacaucgaacuggcccgcgaggugggcaagaaccacucccagcgggccaagaucgagaaggagcaaaacgaaaacuacaaggcgaagaaggacgccgagcucgagugcgagaagcugggccugaagaucaacagcaagaacauccuuaagcugcgccuguucaaggagcagaaggaguucugcgccuacucuggggagaagaucaagaucagcgaccuccaggacgagaagaugcuggagaucgaccacaucuaccccuacucccggagcuucgacgacuccuacaugaacaaggugcuggucuucaccaagcagaaccaggagaagcucaacaagaccccguucgaggccuucggcaacgacagcgccaaguggcagaagaucgaggugcuggcgaagaaccugcccaccaagaagcaaaagcgcauccucgacaaaaacuacaaggacaaggagcagaaggacuucaaggaccggaaccugaacgacacgcgcuacaucgcccggcuggugcucaacuacaccaaggacuaccuggacuuccugccccucucugacgacgagaacaccaagcuaaacgacacccagaagggcagcaaggugcacguggaggccaaguccggcaugcugacgagcgcacuccgccacaccuggggguucuccacgaaggaccgaaacaaccaccuccaccacgccaucgacgcgguaaucaucgccuacgccaacaacagcaucgucaaggccuucuccgacuucaagaaggagcaggagagcaacagcgccgagcuguacgcgaagaagauuuccgagcuggacuacaagaacaagcgcaaguucuucgagcccuucagcggcuuccggcagaagguacuggacaagaucgacgagaucuucgucuccaagccggagcgcaagaagcccagcggcgcccugcacgaggagaccuuccggaaggaggaggaguucuaccaguccuacgggggcaaggagggagugcucaaggcccuggagcugggcaagauccgcaaggugaacgggaagaucgucaagaacggcgacauguuccggguggacaucuucaaacacaagaagacgaacaaguucuacgccgugcccaucuacacuauggacuucgcgcucaagguccugcccaacaaggccguggcccgcagcaagaagggcgagaucaaggacuggauccugauggacgagaacuacgaguucugcuucucccucuacaaggacagccugauccugauccagaccaaggacaugcaggagccggaguucguguacuacaacgccuucaccuccagcacggucucccucaucgugagcaagcacgacaacaaguucgagacccuguccaagaaccagaagauccuguucaagaacgccaacgagaaggaggugaucgccaagagcaucgggauccagaaccucaaggucuucgagaaguacaucguguccgcgcugggcgaggugaccaaggccgaguuccggcagcgcgaggacuucaagaaguga

SEQ ID NO: 7205 - RNA, 2955 nt, Artificial Sequence; identical to SEQ ID NO: 1405
  Cas9 variant

SEQ ID NO: 7206 - RNA, 2958 nt, Artificial Sequence
  Cas9 variant
auggccaagauccuggccuucgacaucggcaucagcuccaucgggugggcuuucguggagaacgacgagcucaaggacugcggcguccguaucuucaccaaggccgagaaccccaagaccggggagagccuggcccugccgcgacgccucgccagauccgcccgcaagcggcuggcgcgccggaaggcccgccugaaccaccucaagcaccugaucgccaacgaguuuaagcugaacuacgaggacuaccagucguucgacgagucccucgccaaggcauacaagggcacgcugauaagccccuacgagcugcgguucaaggccuuaaacgagcugcuguccaagcaggaccucgcccgcgugauacugcacaucgccaagcggcgcggguaugacaacaucaagaacagcgacgacaaggagaagggcgccauccugaaagcggugaaggagaacgaggagaagcucgccaacuacaaguccgucggcgaguaccuguacaaggaauacuuccagaaguucaaggagaacagcaaagaguucaucaacgugcggaacaagaaggaguccuacgagcgcuguaucgcccagucauuccugaaggacgaacucaagcugaucuuccagaagcagcgggaguucggguuuaacuucuccaagaaguucgaggaggaggugcugagcgucgccuucuacaagcgagcccucaaggacuucucccaccuggugggcaacugcagcuucuucguggacgagaagcgggcgcccaagaacagcccccuggccuucgaguucgucgcccucaccaggaucgugaaccugcugaacaaccucaacaagaacaacagcuacaucaaggacgaccugaacgcccugcucuccgagguguugaagaacgggacccugaccuacaagcagacgaagaagauccucggccugagcgacgacuacgaguucaaggggcagaagggcaacuauuucaucgaguucaagaaguacaaggaguucaucaaggcccugugcgagcacaaccucaaccaggacgaccugaacgagaucgcgaaggacaucacccuggucaaggacgagaccaagcuaaagaaggcccuggcgaaguacgaccugaaccagaaccagaucgagaaccucagcaagaucgaguucaaggaccaccugaacaucuccuucaaggcccugaagcucauagugccgcugaugcgggagggcaagaaguacgacgaggugugcaacgagcugaaccugaagacugcaaucaacgaggacaagaaggaguuccuccccgcuuucaacgagacguacuacaaggacgaggucaacaaccccguggugcugcgcgcaaucaaggaguaccggaagguccugaacagccuccugaagaaguacgggaaggugcacaagaucaacaucgagcuggcccgcgaggugggcaagaaccaccgcgagcgguccaagaucgaaaaggagcagaacgagaacuucaaggccaagaaggacgcggagcucgagugcgagaagcuggggcugaagaucaacagcaagaacauccucaagcuccgccuguucaaagagcagaaggaguucugugucuacuccggcgagaagaucaagaucagcgaccuccaggacgagaagaugcucgagaucgaccacaucuaccccuacucccggagcuucgacgacuccuacaugaacaagguucugguguucaccaaacagaaccaggagaagcucaacaagaccccguucgaggccuucggcaaggacgacgucaaguggcagaagaucgagacccuggccaagaacuuacccgccaagaagcagaagcgcauccucgacaagaacuauaaggacaaagagcagaaggacuucaaggaccgcaaccugaacgacacgcgcuacaucgcccggcuggugcucaacuacaccaaggacuaccuggaguuccugccccucagcgacgacgagaacaucaagcugaacgacacccagaagggguccaagguccacguggaggcgaaguccggcauguugaccagcgugcuccgccacacguggggguucagcaccaaggacagaaacaaccaccuccaccacgccaucgacgccgucaucaucgccuacgccaacgcguccgucgugaaggccuucagcgacuucaagaaggagcaagagaacuacaccgccgagcuguacgcgaagaagauaaacgagcuggacuucaagaacaagcgaaaguucuuugagcccuucuccaacuuccggcagaaggucuuggagaagaucgacgagaucuucgugucuaagccggagcgcaaaaagcccucgggcgcccugcacgaggagaccuucuacaaggaggaggaguuuuacaaggaguacgggggcaaggagggcgugcucaaggcgcuggagcuggggaagauccggaaggucaacggcaagaucgugagcaacgccaacauguuccgcguggacaucuucaaguacaagaagacgaacaaguucuacgccguccccaucuacaccauggacuucgcccucgggauccugcccaacaaggcgguggugggcgggaaggacaagcaaggcaucaucaaggacuggcugcucauggacgagaacuacgaguucugcuucagccuguacaaggacucccugauccuccugcagaccaaggacaugcaggaaccggagcuggucuacuucaagagcuucaaguccagcaccgccggccucgugguguccaagcacgacaacaaguucgagaaccugaacgagaaccagaagaagcuguucaagagcgccaacgagaagaaggucguggccgaggggaucggcauccagaaccucaagguguucgagaaguacaucgucuccgcccugggcgagaucacgaaggcggagaucaaggagcgggagaacuucaagaaaaaguga

SEQ ID NO: 7207 - RNA, 2961 nt, Artificial Sequence
  Cas9 variant
augccauccgacccggcagaagccaagccacucgaacuccuggaccccuacgcccuacgggcacaagggcucgaccaagcccuuccccucacgcacuucggcagagcgcuauuccaccucaaccaaagacgcggauucaaauccaaccgcaaaacagaucgcggagacaacgaaaacggaaagauaaaggacgcaucccaacggcuggacugggcaaugcacgaagcaaaagcgcgaaccuacggcgaauuucugcaucugcgacgccaaaaggcaccggaccccagacaagucccaaccguacgcacccgucuaagcgucggcaaacgcggagguccagacgcaaaagaagaggcgggguacgacuuuuacccggacagaagacaccuagaagaagaguuucacgaacuaugguccgcccaagcccaguuccacccagaacuaacacaggaccuccgcgaccuuguauucgagaaaauauucuaccaaagaccacuaaaggaaccaaaaguaggccucugccuauucacuucggaagaaagacucgccaaggcccauccacucacacaacgacgcguucucuacgaaacggucaaccaauuacggaucacagcagacgggcgcagcguacgcccccuaagucgagaacaaagagaccaaauaauccuagcgcucgacacaaagaaacccacaaaaagccucaacucgaugguaguaacacuacaagcucuaggcaaaguacucaaacugcgagaaggagaaagguucacgcucgaauccggaguuagagaagccaucgcaugugaccccguccgcgcggcaaugcucgccacauucggccccagaugguccgcccuagauuggcccgagcaauggcaagucauaucacggguacggaaacuccaagacgacaaagacuucgcugagcuaguagaaugguuaauagaauuauacggugucgacaaggaagcagcagucaaaauagcaaacacacaccuacccgaggguuacggcagacuuggccucacagcaacuaccagaaucuuggacagauuaaaaagcaacguauucacguacgcacaggccguagccgcaugcgguuggcaccauuccgaccaaagaacaggcgaaugccuagaccgccuaccguacuacggggccguacuggacaggcaugucaucccaggaacauacgacgagaacgacgacgauauuacgagguucggacgaaucacuaauccaacgguacacaucggccucaaccagcugagaagacucgugaacaaaauaaucgaaguauacgggaaaccgaaucaaaucguaguagaauuagcccgagaacuuaaacaauccgaacaacagaaaaacgacgccaucaaacuaaucagggacacaacaaccgcagccaaacaaaggucggagaagcuggaggaacuaggcauaacagacaacggacgcaaccgaaugcuacuaagacuuugggaggaccuaaaccccgacgacgcgaugcgaagauucugcccauacacgggacaacggaucucugcagcaaugauauucgacggcagcugcgacgucgaccacauacucccauacucaagaacacuagacgauggcuucgcaaaccgaacccucugucucagagaggcaaacagagaaaagagaaaccaaacgccaugggaagccuggggcggcacccccaacugggaagccaucgaaacaaaccucaagaaccuacccgaaaacaaaagauggcgcuuugcaccagacgcaauggcucgcuuugaaggugaaaacgacuuucucgauagggcgcuaguugacacccaauacuuggcacguaucucucgaacauaccuagacacccuauucacagaaggaggccacguauggguaguccccgggcgccuaaccgagaugcuccgacgacacuggggacuaaacucgcuccuuacggacaaagacaggggagcaguaaaguccaaaaacagaacugaccacagacaccacucaaucgacgcagcaguaguagccgccaccgaccgcagucucuuaaacagaauaucaagagcggcaggccaaggagaaguggcgggccaaagcgcagaacugauagcccgagaaacaccaccacccugggaaggcuucaggaaugaucucaaaagccaacucggacgaauaauaguaagucaccgagccgaccacgguagaaucgacagacaagcacgcaaacaaggaagggacucaaccgcaggccaacuccaccaagaaacugcauacagcauaguagacgacaccagggucgccucucgcaucgacuucuugagcguaaaacccgcacagcuccucgaccaacccggaagaucaggucaagugagggaccugcaacuaagaaaagcgcuacgaguagccaccggugaccucaccggcaaagauuacgaaaaagcacuacgcgacuucgcugccaaaccuggacccuacaaaggaauacgacgcguccggauaaucaaaccacuccaggaacaagcaagaguaccaguacccguacuggaccccauaaaagcauaccaagggggauccaaccacgucuucgaaauauggcaucugcccgacgggaagguggaaccacaagucaucaccagcuucgaggcccacgcgcuagaaguagagaaaagaccccacccagccgcaaaaagacuacuccgaguucacaaaggggacaugguagcccuaaaacgugaaggacgcacagucgucgggcacguacaacaaaugcacaucaaaaacggccuauucaucgucccgcacaacgaagcaaaugcggacgcaagaaacagcgaccgcacagacccauucaaauggauacagauagccgcacaaccagcaauagccgcaggcauccgccgagucgccgucgacgaaaucggcagacuccgggacggcggugccaagacaauauga

SEQ ID NO: 7208 - RNA, 2964 nt, Artificial Sequence; identical to SEQ ID NO: 1408
  Cas9 variant

SEQ ID NO: 7209 - RNA, 2964 nt, Artificial Sequence; identical to SEQ ID NO: 1409
  Cas9 variant

SEQ ID NO: 7210 - RNA, 2964 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagacuggggagucccuggcccugccgcgccggcucgcccgcagcgcacggaagcgccuugcgcggcgcaaggcccggcugaaccaccuaaagcaccugaucgccaacgaguucaagcugaacuacgaggacuaccaguccuucgacgagagccucgccaaggcguacaagggcucccugaucagccccuacgagcugcgcuuccgggccuugaacgagcugcuguccaagcaggauuuugcccgcgucauccuccacaucgccaagcggcgcggguacgacgacaucaagaacaacggcgacgaggagaaguccgagauccugaaggccaucaagcagaacgaggagaagcuggugaacuaccagagcgugggcgaguaccucuacaaggaguacuuccagaaguucaaggagaacagcaaggaguucaucaacguacggaacaagaaggaguccuacgagcgcugcaucgcgcagagcuuccugaaggacgagcugaaacucaucuuccagaagcagcgggaguucggguucuccuucagcaagaaguucgaggaggaggugcuguccguggccuucuacaagcgcgcccugaaggacuucagccaccucgucggaaacugcuccuucuucacggacgagaagcgggcccccaagaacagcccccugguguucauguucguggcccugacccgcaucaucaaccuccugaacaaccugaaaaacaccgaggggauccuuuacaccaaggacgaccugaacgcgcugcucaacgagguccugaagaacgggacgcugaccuacaagcagaccaagaagcuccugggccugagcgacgacuacgaguucaaaggcgagaagggcaccuacuucaucgaguucaagaaguacaaggaguucauaaaggcgcucgacgagcacucgcugagccaggacgaccugaacgagaucgccaaggacaucacgcucaucaaggacgagaucaagcugaagaaggcccuggccaaguacgaccucaaggagaaccagaucgacucccugagcaagcuggaguucaaggaccaccucaacaucuccuucaaggcgcugaagcugaucaccccgcugaugcucgaggggaagaaguacgaugaggccugcaacgagcugaaccugaagguggccaucaacgaggacaagaaggacuuccuccccgccuucaacgagaccuacuacaaggacgaagugaccaaccccgucgugcugcgggccaucaaggaguaccgcaagauccugaacgcgcuccugaagaaguacggcaaggugcacaaaaucaacaucgagcuggcgcgcgaggucgggaagaaccacagccagcgggccaagaucgagaaggagcagaacgagaacuacaaggccaaaaaggacgcggagcucgagugcgagaagcugggccugaagaucaacuccaagaacauccuaaagcugcgccuguucaaagagcaaaaggaguucugcguguacagcggcgagaagaucaagcucuccgaccugcaggacgagaagaugcuggaaaucgaccacaucuaccccuauagccgguccuuugacgacagcuacaugaacaaggugcucgucuucgccaagcagaaccaggagaagcugaacaagacgccguucgaggccuucgggaacgacuccaccaaguggcagaagaucgaggugcugaccaagaaccuacccaccaagaagcagaagcgcauccuggacaagaacuacaaggacaaggagcagaaggacuucaaggaccggaaccugaacgacacgcgcuacaucgcccggcucguacugaauuacacaaaggacuaccuggacuuccucccccugagcgacgacgagaacaccaagcugaacgacacccagaagggcuccaagguccacguggaggccaagagcgggaugcucacguccgcgcugcgccacaccuggggcuucucgacgaaggaccggaacaaccaccuccaccacgccaucgacgccgugaucaucgccuacgccaacaacuccaucgucaaggcguucagcgacuucaagaaggagcaggagagcaacuccgccgagcuguacgcgaaaaagaucagcgaacuggacuacaagaacaagcgcaaguucuucgagcccuucuccggguuccggcagaaggugcuggacaagaucgacgagaucuucgucagcaagccggagaggaagaaacccuccggcgcccuccacgaggagaccuuccggaaggaagaggaguucuaccaaagcuacggcgggaaggaaggcgugcugaaggcccuggagcucgggaagauccgaaaggugaacggcaagaucgucaagaacggggacauguucaggguggacaucuuuaagcacaagaagacgaacaaguucuacgcggugcccaucuacaccauggacuucgcccugaagguccugcccaacaaggccguggcgcgcuccaagaagggcgagaucaaggacuggauccucauggacgagaacuacgaguucugcuucagccuguacaaggacucccugauccucauccagaccaaggacaugcaggagccggagcugguguacuucaaugcguucaccucuucuacggucagccugaucgugucgaagcacgacaacaaguucgagacccucagcaagaaccagaagauccuguucaagaaugccaacgagaaggaggugaucgccaaguccauagggauccagaaccugaaagucuucgagaaguacaucgugagcgcccucggggaggugaccaaggcugaguuccggcagcgcgaggacuucaagaacgagcugcgguga

SEQ ID NO: 7211 - RNA, 2964 nt, Artificial Sequence
  Cas9 variant
auggcccgcauccuggcauucgacaucggcaucagcuccaucgggugggcguucagcgagaacgacgagcucaaggacugcggcgugcggaucuucaccaaggccgagaaccccaagaccggggagucccuggcccugccgcgccggcucgcucgcagcgcccggaagcgucuggcgcggcggaaggcucggcugaaccaccucaagcaccugaucgccaacgaguucaagcugaacuacgaggacuaccaguccuucgacgagucacucgccaaggcguacaagggcucccugaucagccccuacgagcugcgcuuccgggcccucaacgagcuacuguccaagcaggacuucgcccgcgugauccuccacaucgccaagagacgcggguacgacgacaucaagaacagcgacgacaaggagaagggcgccauccugaaagcgaucaagcagaacgaggagaagcuggccaacuaccaguccgugggcgaguaccuguacaaggaguacuuccagaaguucaaggagaacagcaaggaguucacgaacgugcggaacaagaaggaguccuacgagcgcugcaucgcccagagcuuccugaaagacgagcugaagcucaucuucaagaagcagcgggaguucggguucuccuucagcaagaaguucgaggaggagguccugucgguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacacccugcucaacgaggugcugaagaacggcacccugaccuacaagcagacaaagaagcuccuggggcugagcgacgacuacgaguucaagggcgagaagggcaccuacuucaucgaguucaagaaguacaaggaguucaucaaggcccucggggagcacaaccugucccaggacgaccugaacgagaucgccaaggacaucacccucaucaaggacgagaucaagcugaaaaaggcgcuggccaaguacgaccucaaccagaaccagaucgacagccuauccaagcuggaguucaaggaccaccucaacaucagcuucaaggccuugaaacuggugaccccgcugaugcucgaaggcaagaaguaugacgaggccugcaacgagcugaaccugaaggucgccaucaacgaggacaagaaggacuuccucccagcguucaaugagacguacuacaaggacgaggugaccaaccccguggucuuaagggccaucaaggaguaccgcaaggugcugaacgcccuccugaagaaguacgggaaggugcacaagaucaacaucgaguuagcccgcgaggucggcaaaaaccacucccagcgggcgaagaucgagaaggagcagaacgagaacuacaaggccaagaaggacgccgagcucgagugcgagaagcugggccugaagaucaacagcaagaacauccucaagcugcgccuguucaaggagcagaaggaguucugcgccuacuccggggagaagauuaagaucagcgaccuccaggacgagaagaugcuggagaucgaccacaucuaccccuacagucgcagcuucgacgacuccuacaugaauaaggugcucguguucaccaagcagaaccaggagaagcucaaccagaccccguucgaggccuucggcaacgacagcgcgaaguggcagaagaucgagguccuggccaagaaccuacccacgaagaagcagaagcgcauccucgacaaaaacuacaaggacaaggagcagaagaacuucaaggaccggaaccugaacgacaccagguacaucgcccggcuggugcucaacuacaccaaggacuaccuggacuuccugccccucuccgacgacgagaauaccaagcugaacgacacgcagaaggggagcaagguucacgucgaggccaaguccggcaugcugaccagcgcccuccgccacacauggggguucuccgcgaaggaccggaacaaccaccuccaccacgccaucgaugcugugauuaucgccuacgccaacaauagcaucgugaaggccuucuccgacuuuaagaaagagcaggagagcaacagcgccgagcuguacgccaagaagaucuccgagcuugauuacaagaacaagcgcaaguucuucgagcccuucagcggcuuccggcagaagguccuggacaagaucgacgaaaucuuugugucuaagccggagagaaagaagcccucaggcgcucugcacgaggaaaccuucaggaaggaagaggaguucuaccaguccuacgggggcaaggaagggguccucaaggcgcuggagcugggcaagauccgcaaggugaacgggaagaucgugaagaacggugacauguuucgggucgacaucuucaagcacaagaagacgaacaaguucuacgccgugcccaucuacaccauggacuucgcccucaaggugcuucccaacaaggccgucgcccgcagcaagaagggcgagaucaaggacuggauccugauggacgagaacuacgaguucugcuucucccucuacaaggacagccugauccugauccagaccaaggacaugcaggagccggagcucguguacuucaacgcguucaccuccagcacggugucccugaucgucagcaagcacgacaacaaguucgagacccuguccaagaaccagaagauccucuucaagaacgccaacgagaaggaagugaucgccaagagcaucgggauccagaaccugaagguguucgagaaguacaucgucuccgcccuuggcgaggugaccaaggccgaguuccggcagcgugaggacuucaagaacgagcuccgguga

SEQ ID NO: 7212 - RNA, 2964 nt, Artificial Sequence; identical to SEQ ID NO: 1412
  Cas9 variant

SEQ ID NO: 7213 - RNA, 2964 nt, Artificial Sequence; identical to SEQ ID NO: 1413
  Cas9 variant

SEQ ID NO: 7214 - RNA, 2979 nt, Artificial Sequence
  Cas9 variant
augcgcaucuucagugacgggaggaaccccaaagacggcucaaguuuagccgucaccaggcgagcagcaagggcgaugagaaggcgacgagacagacuacugaaacgaaaaacgcgaaugcaagccaaauuagucgaacaugguuucuucccagcagacgccggaaagagaaaagcacucgagcaacucaaccccuacgcccuccgagccaaaggacuacaagaggcacuacuucccggcgaguucgcacgcgcccuauuccacaucaaccaaagaagaggauucaaaagcaauaggaagacagacaagaaagauaaugacagcggaguacugaagaaggcuauaggacaacuacgacaacaaauggccgaacaaggaagcagaacgguaggggaguaccuauggacgaggcuccagcagggacaaggaguaagagcccgcuacagagaaaaaccuuacacaacagaggaagggaagaaacggaucgacaaaagcuacgaccuauacauagacagagcaaugaucgaacaagaguucgacgcgcucugggcagcccaggccgcauucaaccccacacuauuccacgaagcagcgcgagcagaccuaaaagacacccuccuccaucagcggccacuacggcccgucaaaccaggccgcugcacccugcucccagaagaagaacgagcaccacuagcacucccgagcacacaacgcuuccgaauacaccaggaaguaaaccaccuccgacuacuagacgaaaaccuaagggagguggcacuaacacuggcacagagagacgcgguggucacagcccuagaaacgaaggcaaaacucuccuuugaacaaauacgaaaacuacugaaacuaagcggcagcgugcaauucaaccuagaagaugcgaaacgcaccgaacuaaagggcaacgccacguccgccgcacucgccagaaaagaacuauuuggagcagcauggucaggauuugacgaagcacuccaagacgaaaucguauggcaguuggucacagaagaaggcgaaggggcgcuaaucgcauggcuacaaacacauaccggcguggacgaagcaagggcacaagccaucgucgauguaagccugccagaaggguacggcaaccucaguagaaaagcccuagcgcgaaucgucccagcccuaagagcugcaguaaucaccuaugacaaagcuguacaagcagcgggcuucgaccaccacucccaacucggauucgaauacgacgcauccgagguggaagaccucguacaccccgagacaggcgaaauaaggucgguuuucaagcaacuaccauacuacggaaaggcgcuccaaagacacguggccuuugggagcggaaaaccagaagacccggacgaaaaacgguauggcaaaauagcgaauccaacaguacacaucggacuaaaccagguacgcauggucgugaacgcacuaauccgaagguacggacgccccacagaagugguuaucgaacucgcccgagaccucaaacagagccgggaacaaaaagucgaagcccagcgccgccaagcagacaaccagcgcagaaacgcacgaauacgccgauccauagcagaaguccucggcauaggcgaagaacgcgucagaggaucugauauccagaaauggauaugcugggaggaacugagcuucgacgcagccgacagaagaugcccguacagcggagugcagaucuccgccgccaugcuccucagcgacgagguagaaguggaacacauacucccauucagcaaaacgcuggacgauagccuaaacaacaggacgguagcaaugaggcaagcaaauagaauaaagcgcaaccgaacaccaugggaugcgagagcggaguucgaggcccaaggcuggucguacgaggacauccuacagagagccgaacggaugccacuuaggaaaagguaccgguuugccccggacggguacgaacgaugguuaggcgacgacaaagacuuccuagcgcgagcacuaaacgacacacgcuaucucagccgagucgcagcagaauaccuaaggcuaguaugcccaggcacaagagugauaccugggcaacucacagcauuacuacggggaaaguucggacuaaacgacgugcuaggccuagacggagagaagaacagaaacgaccauagacaccacgccguagacgccugcgucauaggcgucaccgaccaaggccuaaugcagcgcuucgcgaccgccucugcgcaagcgagaggagaugggcuuacacgacucgucgacggcaugccaaugccuuggccgacauauagggaccacguagagagagccguaagacacaucugggugagucaccgaccagaccauggauucgaaggagccaugauggaggagacaagcuauggcaucaggaaggauggauccauaaaacaacgcagaaaggcggacggaagcgccggacgagagauaaguaaccucauacggauccacgaagcgacacaaccacuacgacacggagucuccgcagacggccagccacucgcauacaaaggguacguaggagguagcaacuacugcaucgaaaucaccguaaacgacaaaggcaaaugggagggggaagucauaagcaccuuuagggccuacgggguaguaagagcaggagggaugggccgacuacgcaacccacacgaaggacaaaacggaagaaaacuaauaaugcggcuagucaucggggauagcguaagacucgaaguagacggcgcggagagaacaaugcgcauagugaaaaucagcgggucaaacggccaaauauucauggccccaauccacgaggcgaacguagacgcacgcaacacggacaagcaagacgcauucaccuauacgagcaaguacgcagggagccuacagaaagcaaaaaccagaaggguaaccauaucaccaaucggcgaggucagagacccaggcuucaagggcuga

SEQ ID NO: 7215 - RNA, 2985 nt, Artificial Sequence
  Cas9 variant
augacccucggacucgaccucgggacaaacagcaucggcugggcccuaauagacuucgacgacaaccaacaaccacgcaaccucauagccuguggcucaaggauuuuccaagaggcagucgaagccaaaaccggaacccccaaaaaccacgccagacggacagcaagagccgcacgcaaacucguagcccgucgaaaacagcgccgcaccaagcuacucaaccuacucauacgucacggacuacucccacaggacguagccgagcgcaacgcccuucugcuugacaaccaggccaacaacccguaccagcuccggaagcgcgggcucgacgaaaaacucgaaccauucgccuuuggccgcgcucucuaucaccucgcacaccgccgggguuuccagagcaaccguaaagcugccuccgacgaggacggaaaggucaaaaccgccauaagcacacuaagggccgaaaugcagggucgcacacucggcgcguuccucgcggaccagcccacccaacgaagacgauacaccgaccgcgccauguacguggaagaguucgaacagcuuuggagcaagcaggccagcuucacccaagaacaacuuacucaagcacuaaaaguagcaauacacaacucaauauucuuccaaagaccccucaaaucccagaaacaccuagucggcaaaugcacauucgaacccacacgcaaacgagccgcaaaagcaauucuacuaacgcaacgcuuccgcauccuccaggacgugaaccaccucgccgucaaaaaccccaucacccgcgaguuccgaccccucacccaagacgaacgaaauaaacuugcagaagcccucgacaaacaaaaaucaaugaccuggggagccguccgaaaaguaaucggguggaacaagaaagacagcuuacacgagggcgagacauucaaucucgaagagggcaagaaagacaaacucaucggcaaccgcacggcgugcgaucuccgaggggcacugggcgaccggugggacgcacucaccgcccagcaacaggacgaccucgucaccgaccuacucacaaucgacaacacagacggcuuucuaaaacggaugaaaacccacugggaguucgacgacgccacagcggaaguaaucgcaaaaaucgaacuagagccaggcuacgcccgccucuccgcaaaagccaugcgagccauccucccauaccuagaacaaggcaugauuuacucggacgccugcaaagccgccggcuacgaccacuccaaccccaaccaaaggaccaucacugacaaacuaggacuuccuucgaacguccgcaacccagucgugcaaaaagcacucuucgaaacccgcaaaguagugaacgcaaucguccgaaaauauggaaaacccgcaguaauaagagucgaaauggcccgcgacaugaaacucagcaaacgccaaaaggaggaacugcaaaaagagcagaacaaacaaaagaaagcuaacgaacuggcagaaggaauacucagaaaagaguucggaauccaacaacccgcccgcgcggacauucaaaaauacaaccuuuggcucgaaugcaaagaaguaugcccguacacagggaccaccauaagucgagaaaugcuuuucagccccgaggucgacguugagcauauccucccguauagccguucacucgacgacucuuacaugaacaaaacgcuaugcauggcaaccuucaacagacaggucaaacuaaacaacacacccuacgaaauaggacagggggacccacuagccuacgcagaaaucuuccaacgcauaaaaacacuccccuuccccaaacgacgccgauucgaacaaaaagaaauagaaaccgacaaauucauagaacgccaacucaacgacacucgcuacaucugcguggaaguacgcgacuuccuacaacagcucggagcaccgguagaaguaagcaaaggagaagccaccgccaaacuccgugggcgcuggaaacugaacacacuucuaagccccgacggaagcaacgaaaaauaucgcggagaccaccgacaccacgccaucgacgcgguaguaaucgcgcucacaaaccggucccuauuccacaaacucucccgccucuccgcccaaagcaucucacucgacaagagcagauucgacgugcccccacccugggacggauuuuacgacgacgucuacgagaaaaucgauaaaguuauaguaucgcacgcacccgcgcgcaaaauaggaggcgcacuacacgaagacacagcauacgggcacuucaaagaagaagucgcagacccaaaaacagggaaaguaucuaucgaggaucgcuucgucuaccgcaaaccccuugccacccuuaccgccaaugaaguggguaaaauucgggacgccaaaguccgcgaguucguagaagcuagacucgcucaauucggcaauaacagcaaaaccgccuucggcgacccuaacaacccucuccuacacgccgacgguaaaaccccaauuagaaccgucagauuaguaacaaacuucaauaaggccacuacucacgcaauccaaaaaggccaaggucgagacuauaaauucuuuaaauacgguaacaaucaccacgucgaaauaaucgaacacgucgagacgggaaaaaggaagggaaucuucguaacagcaauggaagcagcacgccgcgugcgcggagucgccaacaccgaaaaauccgacaucguccaacgaaaccacggcgaagaguggcgauucgucaugucacucagcauaaacgaccucgugagcauacaggaagccgaccagguacgcaucaugcggguacaacucuucgacgcguccaauggcaacauaaucuucagagaccagaaaagcgccaugcuagacgacaaacuuagccgguaccaaacaaaggcccaccuacucguaugccagaaaauaaccacagauccccuaggcaaccucgcccccugcaacgauuga

SEQ ID NO: 7216 - RNA, 2988 nt, Artificial Sequence
  Cas9 variant
augagcaaagugcuaggacucgacaucggcgcaaacagcauuggcugggcacucaucgacgacgaagaaaacgacaucauuggggccggcguccgcguuuucaaagaaggcgucaaccugaaaggcguaaaggaggaaaguaaaaacgucgagcgccgagcagcgagacucgcccgccgccaacacaaaagacgcucacaaagacguaaccgccucguagcgcugcucaaaacccucgagauguucccugaaaacaacgaagacaucuccgacuauuacgcccaagacccauacgaacuacgcaaaaagggacuauaugaaaagcuaacgauguacgaguucggaagaguccugcuacauauaugccgaagacgaggauucaaaucaucccgaaagacggacaucagcgaagaaggaaaaauauucgagggcaaagacggcauuguagggauaaaccaaacccgcgacagcauacgagaaggaggcuuuaaaacaaucggggaauaccucgccucacuggacccacacguaauucgccgacggaauagauucacacuacgagacauguacgaagaagaguucaacuuaaugugggaaaagcaacaaucauucuacccacuacagcucagcaacgaguucaaagaagcaaucgccgaaguaauccucagccaaaggaaacucaagagccaaaaagcacucguggguaacugcggauuagagccaaacaagaaaacggcgcccaaauccagcccagcguuccaguacuuccggauccuagagcagcuaucccguauucucauaagcaucccacacacaggucgauacaacgacccgcucaaugaagaagaacgucgcaugcucaucgacaaacugucaguaacagaaaaauugaaguucuccgacaugcgcaaaaugcucaaccuccccggggagucagacauaaacaucgaggaagaaggagggagacuacucgggaacacaacauacgcgcggcugaucaagguauucggaaagaagcgcugggcaggcuucagcgaagaagaaaaagaacaaauauggcacaccuuccacuucgccgacaaccacgaauggcuaaaagaauacgcacucaagaaauggaguaucacgcccgacgaaauaaaagaacucgggaaaguggcccuagaaaaagaguacgcccgauucaguaagaagucccucaagaaaaucauaccccaacuagaggaaggguuaacccuagauaaagccaaaaucgaagcgggcuacacaccagaauacgagauagagaaaucucugucagcuuacuugccccuccccgaaaauauacggaauccaaucguacagcaggcacuuuacgagcuacgccacgugguaaacgccguaauaagaaccuacggaaagcccgacaucgccagagucgaacuagcacgcgagaugaagaagcccaaacagaaacgugagaaaaugcgauccgaacuacgcaaaaggcaaaugaaauuugaagaaauaaaauccauccuaaaagaacgacugggcuucaucgauccuaaacgagacgaaauccacaaguacaugcuaugggaggagugcagagagacaugccccuacaccgggcgcaagaucagucucucagcacucuacggaggagacuucgaggucgagcacauaauuccauacaaaagaagccucgacgacagucuuuucaacaagacagugugccucagagaagaaaaccagauaaaaggcgaccgcaccccauacgaggccuacaguggcgaccgccaaaaguacgaagaaauaauacuucggguacaaaagaccaguaugccgcgcggaaagaaaaaccuauucgccauaaaagaacuaaaagacgauuucgcccaucgccaacucagcgauaccgccuacaucuccagagaaacacgaaaauaccucggcagcacaaucaaaaagguacaagcagucaaaggcggauccacagccaaacuacgauacuacuggggacucaacagcauacucggcguccgugacauaaaaaugcgagacgaccaccgccaccacgcaguggacgcguuagucaucgccaacacgacauacgccuucguaaauaccuuauccagauaccacuccauggacguggaaccccacgaaucacgcuuccccuugccgugggagcaguucaggaacgacgcagaauccgucguaaggaacaucuuuguaagccaccggcucggcaagaaagccacaggccagcuucacgaagaaacauacuacggcaaaaucagaaacaccgauggagaacccuauuucguaguccgaaagaaacuaggcacgcuaaccgcgaaacaaauagcaaacaucgucgaccccgucguaaaaacccaagucuucgaacgccucgaagaaaaaggcaucgacauagaaucaucgaauaaaaucccagcggacgccuucgucgaaacccuauacaugccagaccgcaaaacgccaaucaaaucaguccgagugaagguaccgaguacaacaaugauacaacuguacaaggacaaagaacuguacguagauccgggcucgaaccaccacaucguaauauucgaaaacgaggagggaaaaagagacggaaucgucgugucacucuucgaggccgcacagcgccuacgccgcaacgaacccgucauccaaaagacauggaagccggaauggcacuucgugaugucgcucuccauagacgaacucauccugcuagacgucgacgaaaagaacaucgauuggggagacacagggcuggcacucagauacagcaaagcccuauaccgaguccagaaaauggacgucaacaaaaucauaacgcugcggcaucaccucguagcaaggcucaaagacgacgaaggaaaagaguucggacgagaacaucgcauccccagcacgcuccgaggacucaaaguaaagauagaucacauaggacgccuccgucgagccuaugacuga

SEQ ID NO: 7217 - RNA, 2988 nt, Artificial Sequence; identical to SEQ ID NO: 1417
  Cas9 variant

SEQ ID NO: 7218 - RNA, 2988 nt, Artificial Sequence; identical to SEQ ID NO: 1418
  Cas9 variant

SEQ ID NO: 7219 - RNA, 2991 nt, Artificial Sequence
  Cas9 variant
augaugggaaacuucacacucgggcuagaccucggcaccaacuccaucgguugggcccuaaucgacuucgacgacaaccagcaaccccaaaaccucaucgccugcgguucccgcaucuuucaagaagcaguagaggcaaaaacaggcacacccaaaaaccacgcgcgucgcgccgcucgcgcugcccgaaaacuugucgcacgaagaaaacagcggagaacaaaacuacugaaccuccucguaugccacgaccugcuaccacaagacgaggcagaacguaaugcacuucuacuagacaaccaagccaacaacccauaucaacuacgcaaacgcggccucgacgaaaaacucgaaccauucgcauucgggagagcacucuaccacuuggcccauagaaggggauuccaaagcaacaggaaagcagccucggacgaagacggcaaagucaaaaccgccaucucagcccuacgggcagaaaugcaagggcacacacugggcgcauuccucgccgaccaaccaacccaacgccgaagauacacagaccgugccauguaugcggaagaguucgaacagcuauggagcaaacaaacaaucuucgcuccugaacaacucacacaggcccucaaaguagagaucaaaaacuccauauucuuucaacgcccccuaaaaagccaaaaacaccucgucgggaaaugcaccuucgaaccgacaaggaaaagagcagccaaggccauccuccucgcccaacauuucagaauccuccaagauguaaaucaccucgcagucaagaaucccauuacgcgagaguucaggccccuaacacaggacgagcgcaacaaacuagccgaagcgcuagacaaacaaaaagguaugaacuggagugcgguacguaaagucaucggcuggaauaagaaagacucccuccacgaaggagaaacguuuaacuuagaagaaggcaagaaggacaaacuaaucggaaaccgaaccgccugcgaccuccggggagcccuaggcgaccgaugggacgccuucacagcgccccaacaagacgaccucgucaccgaccuccugacaaucgacaaucccgacggguuccuaaaacgcaugaaaacccacuggggcuucgacgacgcuacggcugaagcacuagccacaacagagcuugaacccggauacgcccgcuuguccuccaaagccaugcgcgcaauauuaccccaccuggaacagggaaugauuuacucagaugccugcaaagccgcuggcuacgaccacagcaaccccaaccagcgcacaaucacagacaagcucggucuacccuccaacguacgaaacccagucguccaaaaggcgcuguucgaaacccguaaaguuguaaacgcaauuguccgaaaguacgggaagcccgcagucauccgcguagaaauggccagagacaugaaguuauccaaaagacaaaaagaggaacuacagaaagagcaaaacaaacaaaagaaagcaaacgaacucgccgagggaauccuucgaaaagaguucggcauccaacaaccugcgaggacagacauacaaaaauauaaccucuggcucgaaugcaaagaagugugcccauacaccggcacgguaaucucccgagaaaugcucuacucaccagaaguggacguagaacacauccugcccuauagccgaucccuagacgacucuuacaugaauaagacacuuugcauggcaacauacaaccgccagacaaaacugaacaacacccccuacgaaaucggucaaggcgacccugucgcguaugccgagaucuuccaaagaaucaaaacccuaccauucccaaaacgacgaagauucgaacaaaaagaaauagaaacagacaaauucaucgaaagacaacuaaacgacacccgcuacaucuguguagaagugcgugacuuucuccagcaacucggcgcacccguagaagucucuaaaggugaagccaccgcuaaacuccgcggucgcuggaaacuaaacacccuacuaagccccggcggcggcaacgaaaagaaccgagcagaccaccgccaccaugccaucgacgcaguagucauagcgcuaaccaaccgaucccucuuccauaagcucucacgccuaagcgcacaauccauauccuucgacaaaucucgcuuugacgucccaccacccugggacgacuucuacgacgacgucuacgaaaagauagauaaaguuaucgucagccacgcccccacccgaaaaaucucaggcgcgcuccaugaagcaacagcauacggacacuucaaagaagaaaucgcagaucccaaaacaggaaaauucagcauugaagacagauuuguguaccgaaagccucuaacuacacucaccgcuaacgaagucggcaagauacgagacgcuaaaguacgagagcuagucgaagcccgacuggcccaauucggaaacaacuccaaggccgcauucggagauccaaacgaaccguuacuacacgccgacggcaaaaccccaauccggaccauccgccuaacgaccaacuucaacaaaaccaccacccacgccauacaaaagggccaagaccgagacuacaaauucuucaaauacggcaacaaccaccacguagaaaucaucgagcacguggaaacaggcaaacgaaaaggcauauucguaaccgcaauggaggcagcccgucgagcacgcggcgucgccaacaccgaaaaauccaacauuguccaacgcaaccacggcgauggguggaaauucgucaugucucuagcugugaacgacauggucagaacugaagacacgcaagcgauauaccgcguccaaaaacucgacggaagcaacaauagauucacccuccggucccacaacgccgcaacccucgaugacaaacaaacaggcgucgacaaaacaccaaaccuauucaagggaaccaaaaucauagucgacccguugggaaaccuaacccagugcaacgacuga

SEQ ID NO: 7220 - RNA, 2994 nt, Artificial Sequence
  Cas9 variant
augaaaguauuaguagacgcaggccucaugccaagcgacccagccgccgcaaaagcacuagaaacacucgacccauacgaacugagggccaccgggcuagacgugaugcugccccuaacacaccuaggcagagcaguauuucaccuaaaccaacgccgcggauucaaguccaaccgaaaaaccgacaggggcgacaacgaaucaggaaaaauaaaagacgccaccaagcgacuaacaugggccaugcaagaagccggggccagaaccuacggcgaguuccuacacaugagacgagcccgagcgagcgaccccaggcaagugccaagcguccgcacacgacuaagcgucgcaagcagaggcggacccgacagcaaagaagaagccggauacgacuucuaccccgaaagagcacaccuggaagaugaguuccaugcacuauggucugcccaagccgcauuccaucccgaccucacaugcgaacugagggaugucguauucgaaaagaucuucuaucaaaggccucuaaaggaacccaaaguaggacucugucuauucaccgccgaagaaagacuaccaaaagcucauccacucaccgggcgaaggguccuauacgaaaccgucaaccaacuccggguaacggccgacggacgaaccacccgaccacuuacgcuagaagagagagacaugaucguguacgccuuagacaacaagaaaccagucaaaucacuaagcucaaugcaccuuaaacugguagcccugggaaaacucguaaaacuaaaggacggcgaacgcuucacccucgaaagcggagugcgggacgccaucgccugcgacccaauacgcgccaccaugggacauccagacggauucgggcccgcauggucacgacuagacuggcaggcccaaugggcacucauagagaaacugaggcaagugcagucggacgacgacuucgcgagccugguagcauggcugggagcgacccacaaucuaagcgaggaccacgcaaaaagaguagcaaaccugcaccuaccagagggcuacggcagauuaggacuaacagcaacagaagcgauacuaugcaaccucaaagcggaaguaugcacauacagccaagcagucgaaagauggggaaagcaccacagcaaccaacggacaggagaaugccuugaggcucucccauauuacggcgaaguacucgacagacauguaauucccgggacguacaacgaagacgacgacgacgugacacgcuauggacgaaucacaaacccuacaguacacauagguuuaaaccagcugcgaagacucgucaacagaauaaucgcaaccuacggcaagcccgaucaaauagucguggaacuagcccgagagcuuaaacaaagcgaggcccagaaguccgaagcccucaagaaaauaagagacacaacagccgacgcaauacgcagaggccgacaacucgaggaaauagggcagaaaaacaccggcgccaacagacuacuacuccgauuaugggaagaccuaggaccagccgucggcccaagaugcugccccuacaccggcaaaccgaucucaguaacuauguuauucgacggggcaugcgacgucgaccacauccucccauauucaaggacacuagacgacucguucgccaacaggaccauaugccuccgagaagccaaccgacaaaaaggagaccgaacgccaugggaagccuggggaggguccgaccagugggacgcaaucgaggccaaccugaaagaccuacccgaaaacaaacgcaaacgauuugcacccgacgccauggaacgcuucgagggggaacgcgacuuccucgaccgagcccuagucgacacacaguacuuggcgaggauaucacgggcguaccuagacacccuauucacugaaggaggccacguguggguaguaccgggacgaaugacagaaauguuaagacgacacuggggucuaaacgcacugcugagcgacaaagaccgcggcgcaggaaaggugaaaaacagaaccgaccaccgacaccacgcgauugacgcggccguaauagcagcgacagaccauagccucguaaaccgaaucucuaaagcagcaggccaaggagaaagcgcaggccaguccgccgagcuaauagccagagacacaccagaacccugggaaggauucagaaacgacauaagcgcacaaauagcacggauuguagucagccaccgagcagaccacggaaggauagacguagaaggccgcaaacacggcaaagacuccacagcaggccgacuacacaacgacaccgcguacgggaucguagacgaccacacagucgugagccgaaccccgcuauuaucacucaaacccggagacauagaaguaaccacaaaaggcaaaaacauacgagauacgcaacuccaaaaagcccuaucgguagcgacuacgggaaaggacgggaaaggauucgaggaggcacuacgcaacuucgccgagaaagaaggaccauaccaagguauccgacggguccgucucaucgaaacacuacaaagcucagcgaggguagagguagggagcgacgaagacggccaaccccucaaagcauacaagggggacuccaaccauugcuacgaccuauggaagcuacccgauggaaagguaguaccacacguagucagcacguacgaagcacaugccgguaccgacaagagaccacacccggcugccaaaagaauacugcgcguauuuaagaaagauauggucgccauagaacaagacgaccaaaccgcgauauuuuacguacaaaaacuagacagggcaaacggccuauuccucgcaccccaccuagaagccaacgcagacgcacgccaccggaacccaaacgacgccuucaaauuccuccaaaugggggccggaagcguugucagaaacaaacuccgaagaguauacguagacgagauaggaagaauaaaagaccccgggcccccaaaacacuga

SEQ ID NO: 7221 - RNA, 2994 nt, Artificial Sequence
  Cas9 variant
augaagauccugggcuucgacaucgggaucaacagcaucggcugggccuucguggagaacgacgagcucaaggacugcgggguccgcaucuucaccgaggccgagaaccccuccaacaaagagagccuggcgcugccgcggcgcaacgcccgguccagccgccggcgccucaagcggcgcaaggcccggcugguagccauaaagcgcauccuggccaaggagcucaagcugaacuucaaggacuacguggcggccgacggcgagcugcccaaggccuaugaggggaagcucaccuccaucuacgagcugcgguacaaggcccugauccagcagcucgagacgaaggaccuggcgcgcgucauccugcacaucgccaagcaccggggcuacaugaacaagaacgagaagaaguccaacgacaccaaaaagggcaagauccucagcgcccugaagaauaacgcccugaagcuagaaaacuaccagagcgugggggaguauuucuacaaagaguucuuccagaaguacaaggaaaacaccaagaacuucaucaagauccgcaacaccaaagacaacuacaacaacugcguacuguccagcgaccuggagaaggagcucaagcugauccuggagaagcagaaggaguucgguuacaacuacuccgaagacuucaucaacgagauccucaaggucgccuucuuccagcggccccugaaggacuucagccaccuggugggggcgugcacguucuucgaggaagagaagcgcgccugcaagaacuccuacucagccugggaguucguggcccucacaaagaucaucaacgagaucaagucccuggagaagaucagcggcgagauaguucccacccagaccaucaacgagaucuugaaccucauccuggacaagggguccaucacguacaagaaguuccggagcugcaucaaccugcacgaguccaucagcuucaagagccucaaguacgacaaggaaaacgccgagaacgcgaagcugaucgacuuccgcaagcugguggaguucaagaaggcccucggugugcacucccugagucggcaggagcuggaccagaucuccacccacaucacccucaucaaggacaacgucaagcugaagaccgugcuggagaaguacaaccucagcaacgagcagaucaacaaccugcuggagaucgaguucaacgacuacaucaaccucuccuucaaggcccugggcaugauccugccgcucaugcgcgaggggaagcgguacuacgaggccugcgagaucacgaaccugaagcccaagaccguagacgagaaggaggacuuucugcccgcguucugcgacagcaucuucgcgcacgagcugucgaaccccgucgugaaccgcgccaucagcgaguaccgcaaggugcucaacgcgcugcugaaaaaguacggcaagguccacaagauccaccucgaguuggcccgggacguggggcuguccaagaaggcccgcgagaagauugaggaccagcagaagaauaacaaggcgaucaacgacugggcccucaaggagugcgagaacaucggcaucaaggcgagugccaagaacauccugaagcugaagcucuggaaagagcagaaggagaucugcaucuacuccggcaacaagaucagcaucgagcaccugaaagacgagaaggcgcuggagguggaccacaucuacccguacucccgguccuucgacgacuccuucaucaacaagguccucguguucaccaaggagaaccaggagaagcugaacaaaacccccuucgaggccuucgggaagaacaucgagaaguggagcaagauccagacgcuggcccagaacuugcccuacaagaagaagaacaagauccuggacgagaacuucaaggacaagcaacagcaggacuucaucucccggaaccugaacgacacccgguacaucaccacccucaucgccaaauacacgaaggaguaccugaacuuccugccccugagcgagaacgagaacaccaaccugaaguccggcgagaaggggagcaagauccacauccagaccaucagcggcaugcugaccuccgugcuccgccacacguggggguucgacaagaaggaccggaacaaccaccuacaucacgccuuggacgcgaucaucgucgccuacuccaccuccagcaucaucaaggccuucuccgacuucaagaagaaccaggagcuucugaaggcccgcuucuacgccaaggagcugaccagcgacaacuacaagcaccaggugaaguucuucgagccauucaagggcuuccgggagaagauccucuccaagaucgacgagaucuuugucagcacuccgccccgcaagcgggcccgcggcgcccugcacgaggagacguucuacuccgaggacaagaugaucaagaaguacaacagcaaggaggggcugcaaaucgcccucagcugcggacgggugagaaagaucgggaccaaguacguggagaacgacaccaugguccggguggacaucuucaagaagcagaacaaguucuacgccauccccaucuacgugauggacuucgcucugggcauauuacccaacaagaucgucaucaccggaaaggacaagaacaacaaccccaagcaguggcagacuaucgacgagagcuacgaguucugcuucucccucuacaagaacgaccugauccugcuccagaagaagaacaugcaggagcccgaguucgcguacuacaacucuuucgacauagaccgcucccggaucaagaucaagaagcacgacaacaaguucgagaaccugaccagcaaccagaagcugcuguucaccaacaaggacaagggcaagaaccgcaccggcauccagaaccugaagaucuucgagaaguacaucgugacgccccugggggacaagaucaaggccgacuuccagccgcgggagaacaucucccucaaaaccagcaagaagcacggccuguga

SEQ ID NO: 7222 - RNA, 2994 nt, Artificial Sequence
  Cas9 variant
augggcaauuacacacuaggacuagacauaggcagcaauucaauagggugggcgcuagucgaggacgcaguagaagcaccccggaucguggacaugggagucagagucuucccagaaggaguagaccgagacacgaagggccuagaaaaaucgaaaaacgcaacuagacgagaggcacggggugcacgacgaacacaucaacgacgccgccaacgaaaacaaaggcuaguaagagcacuccgacaggucgggcuccuaccaugcgacaaagcagaaguacggucccuauuccaaaccgacccauacgaaauacgcaaacgcggccucgaccacagacuagagcuauacgaaauaggccgugcauucuaccaucuaucccaacgucggggguucaaauccaaccggaaaagcggggcccuaaaggaagacggaacuguuaagaaagaagccggagaacuccagagaaaaauagacgaagccggguguaggacgaucggagaguacuucgcaggucuagacccagagcagcagcgcauccguggccgcuauaccuuccgaagcauguaccagaaggaguucgaccuccugugggcgaaacaagucgaguucuaccccaaagugcuaacagaagaccuccgcagcaaagugcgcgacgaaaucaucuucuuccagcggccccuaaaaagugcgaaggaccucauaggcgauugcgaauuggaaccaacagagaagagaugcccgagagcagacugguacgcacgacgcuuccgacuccuccaagacaucaacaaccuuauaauacaaaaccccgacggaaccgagcaaaaacucagcccagaccaacgcgccgcccuacucggagaauuaggccagcgagagaaacucacuuucgacaacauucgcgcuaaacuaggauugcucgagacacaaaaguucaacgcagaauaccgaaucggaagaaaaggaaagaaagucgaggccauaaaaggcgacgucuucguauggacgaugagaggaaaaucagucuucggaccaaaagcaugggacgcaauggccgacgaacgaaaaguaagccugaacgaacuguucgucgaacucgaagacgacgaccucgcccgaaaacucgaaacagaauacggucucacggacaaacaaguucaagcagccaugaaagcaagccugccccagggauacaugucguucagucgcaaagcuguccuaaaacuccuuccauucauggaagcaggcgcccucacacacgaggcgauagaccaagccggauacagaaaagaagaacccacccaaaccgacgcgauagcgcgagugucauuucccccagaccucagaaaucccaucguccaaaaagcccucuucgaaguaagaaaagugguaaacgcauuaguacgugaguacggaaaaccaacacgcaucaaaauagaaauggccagagacguacaaggcuccaaacgacaacgagaagaauuacacuggaggaacgaagacaacagaaagaaaaaugaagaagucagagacagacucagaaccgauauccacauugacgacccgagucgagacgacguaaucaaauacaaacuguggcaagaaagcggcaagaugugcccauacacaggaagacaaaucugccaagaagcccucuucggaccgaaccccgaguuccaaguagaacacauacuacccuaugaccgcagccucgacgacuccuacaugaaccuaacccugugugaaguucacgaaaacauacauggaaaacgcaaccaaacccccuucgaagcauacgggagcggagcagagcgauacgaacaaauuaagcaacgcaucaaaguccuacccuggccaaaacgacaaaaauuccuacaacaggaaaucaaccuagacagccacauaagcagagaacucaacgacaccagguacaucugccgagagacaguagcauaccucaaacaacucggagugcacguacgaggaacucgcggaaagauaacagccgaacucagacaccaguggggucucgacggcaucuucucagagcuaggcgucagacgcgacgacgaccaccgcagacacgccguggaugcccucgucguggccguaaccgacaacgaacaccuacgacggcuggcagucagcaaauacgugcuggccggcccacguuucgaaacgccguggucagcauucagggacgaagcgaggggaaacgugaaaagaaugaacgugagccaucgcgugugcaggaagguauccggagcccugcacgaagaaacaaauuacggacccaccggaguacgagaccaggcaggccaagacauauacgcauacaggaaaaagcuggaagacuuaacaacuccaaugguagagaaaauaguagacccaguaguccgcgacaucguacgccaaaggcuucuuaugaagggaauagacccagccgcggcagaccgcaaaaucccaaaagacguauggaaagaaccacuauauaugcgccggacuaagagcgacaaaaugauccaaauacgacgggucagaauccacgacgucaaaaacucgauuauaguacuaacggacgaaagcgggagacccuacagagccguagagccgggagggaaccaccaugucgaaguauucgaguacguacacggcacaaaaacaggcacacgggaagcggaggucguaacaauguucgaagccguucgaagaucaagagcccgggcacccguuguacgccgagaccacggccccggaacccgauuugugugcagucuagccauaaacgacauggucaugaugccagacaagagcgggaaaauggaccuguuucgaauacaaaagaugagugccagcaaacaagucuacuucaggcaccacacagccgcacgaaucgacagcgaacgcacacugauccgaaagcaggcacaccucuucaacggguacaagguaucagucgacccaacaggagcuauaugccgagcaaacgacuga

SEQ ID NO: 7223 - RNA, 3000 nt, Artificial Sequence
  Cas9 variant
augaaaauccuuggcuucgacauuggaaucaacagcaucgggugggccuucguggaggacaaccagcuccaggacugcgggguccgacuguucacaaaagccgaggaccccaagaccaaggagucccuggcucucccgaggcgcaacgcccggagcaaccgccggcgccucggccggcgucggucgcgccugaucgcccucaagcacaucaucagcaaagggcugaagcugaacuaccaagacuacaucgccaacgauggcgagcuccccaaagccuacgagggccggcugaucucucccuacgaacugcgcuacaaggcgcucaacgagaagaucgagcccaaggacuuggcccggguuaucuugcauaucgccaagcacagaggguacaugaacaagaacgagaaaaagagcagcgacaacgagaaggggaagauccucagcgcacugaagacgaaugcucuaaagcucgagaaguaccaguccgugggagaguacuucuacaaagaguucuuccagaaguaucgggaaaacaccaaagacuucaucaacauccgcaacaaggaaggcagcuacgagaacugcguacuggccuccgaccuggagaaggagcucaagcugauccuggagaagcagaaggaguggggcuacagcuacaacgacaacuucaucaaggagauccucaaaguggccuucuuccagcggccgcugaaggacuucuccuaccuggugggcgccugcaccuucuucgaggacgagaagagagccugcaagaacagcuacuccgcgugggaguucguagcccucaccaagaucaucaacgagcucaagagccuggagaaggaguccggcgagcucgugagcucccaaaucaucaacgaaauccugaaccacauccuggacaagggguccaucacguacaagaaauuccgggaguacaucaagcuccacgagagcaugaaguucaaguccuuaaaguacgacaaagacaacguggagagcaccaagcugaucgaguuucgcaagcucgucgaguucaagaaggcccugggcgaacacucccugagccgggaggagcucgaccagaucgccaccuacaucaccuuaaucaaagacaaugagaagcugaagaucacgcucgagaaguacucccugaacaacgagcagaucaagaaccuucucgagaucgacuucaacgaccacaucaaccugagcuucaaggcccucaaccucauccugccacuuaugaaggaggggaagcgcuacgacgaagcaugcaagcugcucaaccugaagaccaaguccaacaaccaaaaguucgacuucuuacccgccuuuugcgacagcaucuucgcccaagagcuaaccaaccccaucgugaaccgcgccaucuccgaauaccggaaggugcugaacgcccugcucaagaaauauggcaagaugcauaagauccauaucgagcuggcgcgcgacaucggccugagcaagaagcuccgggccaagaucgagaaggagcagaaggagaacuacgagaacaacaucugggcccugaacgagugcgagaaguucgggcugaaggccaaugccaagaacauccucaagcugaagcuguggaaggagcagaaagaguucugcauauacucgggcaagaagaucagcaucgagcaccuccgcgacgagaaggcgcuggaggucgaccacaucuacccguacucccggagcuucgacgacuccuuccugaacaaggugcucguguucacaaaggagaaucaggagaaguugaacaagacgcccuucgaggccuucggggccaacgaggaacgcuggagcaagauccaggcccuggcacagaaccuccccuacaagaagaagaacaagauccuggacgaggccuucaagggcaagcagcagcaggacuucaucucccggaaccugaacgauacccgcuacaucucaacccuaaucgucaaguacaccaaggaguaccuggacuuccugccccucgacgagaaggaggacgugaaccugaagucgggggagaagggcagcaagauccacgugcagacgaucaacggcaugcugaccagcguccuccggcacacuuggggguuugcccagaaggaccgcaacaaccaccuccaccaugcucuggacgccaccaucguggcauacucuacgaacgcaaucaucaaggccuucagcgacuucaagaaggagcaggagcugcugaaggccaagcuguacgccaaggagcucacuuccgacagcuacaagcaucaagcgaaguucuucgagccguucgagggcuuucgggagcagauccugaaccaaaucaacaagcuguuuguuuccaagccgccccgcaagcgggcucgcggggcccuccacaaggagaccuucuacucuaaggacgagaugaucaagaaguacaacucccaggagggcgucgagaucgcccugaacugcgggaagauccggaagaucggcaccaaguacguggaaaacgacacaauggugcgcauagacaucuucaagaagcagaacaaguucuacgccaucccuaucuacaccauggauuucgcccugggcguccuccccaacaagaucgugaucaucgggaaggacaagaagggcaaccccaaacaauggcaggagaucgacgaguccuaugaguucugcuucucccugcacaaggacgaccugguccucauccagaagaaggacaugcaggaacccgaguucgccuacuacaacggguucgacaucuccaacuccagcaucugcguggagaagcacgacaacaaguucgagaaccugaccgacaaccagcggcugcuguucacgaacgccgagggcaacgugaaggccaagaagaucgggauccagggccugcgcaucuucgagaaguacaucaucacgccccugggcgagaagaucaaggccgacuucaagccgcgggaggacaucgcccucaaaaccuccaaaaagcacgggcuguga

SEQ ID NO: 7224 - RNA, 3003 nt, Artificial Sequence
  Cas9 variant
augaagauccugggcuuugacaucgggaucaacagcaucggcugggccuuuguggagaacgacgagcucaaggacugcgggguccgcaucuucacaaaggccgagaaccccaagaacaaggagucccuggcgcugccgcggcgcaacgcccggagcucccgccggcgccucaagcggcggaaggcccggcugaucgccaucaagcgcauccuggccaaggagcucaagcugaacuucaaggacuacguggcggccgacggggagcugcccaaggccuacgaggggagccucgccuccguguacgagcugcgauacaaggcgcugacccagaagcucgagacgaaggaccuggcccgcgucauccugcacaucgccaagcaccggggcuacaugaacaagaaugagaagaaguccaacgacgccaagaagggcaagauccucagcgcccugaagaacaacgcgcugaagcucgagaacuaccagagcguuggggaguacuucuacaaggaguucuuccagaaguacaaggagaacaccaagaacuucaucaagauccgcaacaccaaggacaacuacaacaacugcgugcuguccagcgaucuggagaaagagcucaaguucauccuggagaagcagaaggaguucggguacaaguacuccgagggguucaucaacgagauccugaaggucgccuucuuccagcggccccucaaggacuucagccaccuggugggcgcuuguaccuucuucgaggaggagaaccgcgccugcaagaacuccuacagcgccugggaguucguggcgcucacgaagaucaucaacgagaucaagucccucgaaaagaucagcggggagaucgucucgacccagaccaucaacgaaguacugaaccugauucuagacaagggcucaaucaccuacaagaaguuccgguccugcaucaaccugcacgagagcaucagcuucaagucccugaaguacgacaaggagaacgccgagaacgccaagcucaucgacuuccgcaagcugguggaguucaagaaggcccugggcguccacagccucucccggcaggagcuggaccagauaagcacgcacgugacccugauuaaggacaacgugaagcucaagaccguccuggagaaguacaaccuguccaacgagcagaucaacaaccuccuggagaucgaguucaacgacuacaucaaccugagcuucaaggcucucgggaugauccugccccugaugcgcgagggcaagagguacgacgaagcgugugagaucaccaacuugaagccgaagacgguggacgagaagaaagacuuccugcccgccuucugcgacuccaucuuugcccacgagcugagcaaccccguggucaaccgcgccaucuccgaguaccgcaaggugcugaacgcccuccugaagaaguacgacaaaguacacaagauccaccuggagcucgcgcgggaugucgggcugagcaagaaggcccgcgagaagaucgagaaggagcagaaggagaaccaggccgugaacgccugggcgcuuaaggagugcgagaacaucggccucaaggccuccgccaagaacauccugaagcugaagcucuggaaggagcagaaggagaucugcaucuacagcggcaacaagaucuccaucgagcaccugaaggacgaaaaggcccuggagguggaccacaucuaccccuacagccgguccuucgacgacagcuucaugaacaagguccucguguucaccaaggagaaccaggagaagcugaacaagaccccguucgaggccuucgguaagaacaucgagaagugguccaagauccagacccuggcgcagaaccuccccuacaaaaagaagaacaagauccuggacgagaacuucaaggacaagcagcaggaggacuucaucagccgcaaccugaacgacacgcgguacauagccacccucaucaccaaguacaccaaggaguaccugaacuuccugccccucaacgagaacgaaaacacgaaccugaaguccggcgagaaggggagcaagauccacguccagaccgugaacggcaugcugaccagcgugcuccgccacaccuggggguucgacaagaaggaccggaacaaccaccuccaccacgcccuggacgccauuaucgucgccuacuccacgaacagcaucaucaaggcguucuccgacuucaagaagaaccaggaacugcugaaggcccgcuucuacgccaaggagcugaccagcgacaacuacaagcaccaggugaaguucuucgagcccuucaagggcuuccgggagaagauccucuccaagauugacgaaaucuucgugagcaaaccgccccgcaagcgggcccgcggcgcccugcacaaggagaccuucuacuccgaggacgagaugaucaagaaguacaacagcaaggaggggcugcagaucgcgcucuccugcggccggguccgcaagaucgggaccaaguacguggagaacgacaccauggugcgugucgacaucuucaagaagcagaacaaguucuacgccauccccauauacgccauggacuucgcccugggcauccugccgaacaagaucgugguggucgggaaggacaagaacaacaacccgaagcaauggcagaccaucgacgagagcuacgaguucugcuucucccucuacaagaacgaccugaucaugcugcagaagaaggacaugcaggaggcggaguucgccuacuacaacggcuucgacaucagcaccuccagcaucugcguggagaagcacgacuccaaguucgagaaccucaccagcaaccaaaagcugcuguucuccaacgcgaaggagggcagcgugaaggucgagaaccucgggauccagaaccugaagaucuucgagaaguacaucaucacgccccugggcgacaagaucaaggccgacuuccagccccgcgagaacaucagccucaagaccuccaagaagaacgggcuguga

SEQ ID NO: 7225 - RNA, 3003 nt, Artificial Sequence
  Cas9 variant
auggccagggcccaacgacgccuuauaaguaggagagccaaccguaugaacaaacuccgaagacuacuaaagcaagagaacguacuacaagcaaacgacuacgacgaaaaaggccugauuaucggacucccaaaccaagccugggaguuaagagcacaaggacucgaccgaaagcuagaaccuaaggaaugggcagccguccucaucaaccuagucaaacacagaggcuaccucagccaacgaaagaacgagagccaaaccgcugacaaagagcuaggagcacuacuguccggaaugaaccacaaccaccaacuccuccaaucgcaaagcaaccaauaccgcacgcccgcggaacucgcaaucaaacaauucgccacccaagauggccauauccgcaaucaacgcggcgccuacacccauacguucaauagacuagaucugcagaaugaacuaaaccaacucuucgacgcucaaacucgccucggcaacccccacgucucugggucacuuaaaaccgccaucaacgaccuacucaugaaccagaaagcggcccugucaggcgacgcuauccuagaaauguuaggaagaugcacauucgaaccaucagaguacaaagcagccaagaacacuuacagcgcagagagauucgucugguuaggcaaacuaaccaaccuccgaauccaagacaauggucuagaaucagcccucucgcgagaacaaagggagcuccuccucaacgaacccuacaacaaaacuaaacucacauaccaacaaguccgcaaacuucuccgccuaccagaaaccgcauucuucaaaggccuccguuacggaaaagacaacgccgaaucagcaaccuucauggaaaugaaaucauaccacgcaauacgcaagucccucgaaaacaagaguuuaaaauccgaaugggaaaaacugaagacccaacccaaacuccuugauuuaauaggcacagccuucagcauauacaaaacugacgacgaaaucgcaggaugccucaaaaaucaacuaccagaaaacgucaucauagcccuucaagaacaacucaacuucagcaauuucauggaacucucacugaaagcccuagaaaaacuacucccacucauggaacaaggacuccgcuacgacgaagccugcacccaaaucuacggaaauagacacgagaaaaucgcagacaaaacggaaaaguuccuuccaaauaucccagcagacaagcuacgaaacccagucguccucaggacccucacacaggcgcgcaaagugaucaaugcaauuauucgccgcuacggcagccccgccagaguacacauagaaacgggccgugaaguuggcaaaucauuuucugaccgcgacaaacuuaaaaagcaacaagaggaaaaucaagaacagcggcggcgcgcuauagacgaauggaagcaguucuuccccaacgccgcgcacgagccaaaagcugucgacauccugaagcugagacuauaucaacuacaacaaggaaaaugccuauacuccggccuacccaucgacgucaggcgucuccccgaaaaaggauacgucgaaaucgaccaugcgcuacccuucucgcgaacgugggacgacagcuucaacaacaagauacucguacucgccuccgaaaaccaaaacaaaggaaaccagacaccauacgaauaccugcgaggcgcagacaacagcgagagcuggcgacuguucgucgaaaacguacaaaacugccaguuuucccccaacaagaaacaaaagaucauggccaagcaacucgacgaaaagggcuuccucgaaaggaaccucaacgacacccgauacgugagccgcuuucucugccaauucauaagugaacaccuccaccuaacaggaaaaggcaagaaacgggucuuugcaucgaauggucaaaucaccgcccuccugagaggccgcuggggccuaagcaaaaacagagaagaaaacgaccgacaccacgcagucgaugcggucguuguagcaugcuccaccgucgccaugcaacagaagaucacgcaauucguccgcuaucaaaagggaaacguguucacgggagaacgcaucgacaaggaaaccggcgaggucaucuccauacacuuccccacccccugggaacacuuccgagaagagguaaugauacgcgucuucgacgauaacccgcuccgcacccuacccgaaaaacuccccaaccgccccgaagcacuacaugaauacgugaugccucucuucguaucgcgaaugcccaccaggaaaaugaccggucagggccacaaagaaaccaucaaaagcgccaagcgccucgacgagaaaauaagcguacuacgcgugccacuuacacaacugaagcucaacgaccuagaaaacaugguaaaccgcgaacgcgaacccgcacucuacgaggcccugaaagcacgccucgaacaauucaaaaaugacccagccaaagccuucgccgagcccuucuucaaacaaggcggacaacaagugaaagccguucgagucgaaaucguccagaaaagcgggaugcuccuccggaaaauuaacggcguagcagacaacggcucaaugguccgagucgacgucuucgagaaaagcggcaaguucuacuuagugcccauauacgcauggcaagucgccgaagguauacuccccaacuacgccgucguugcccacaaggacgaauccgacuggauccuaauggacgaaagcuaccacuucaaauucgcacuuuacaagaacgaccuacuggaaguccaaaccaaaaagggcggcauaaugggguacuucgccucccucgaccgagcaacaggcgcaaucaccauacgggagcacgaucgagacaaaaagaaaugcaaagacggagagcaccgaucgaucggaguuaaaauggccagcucauucaagaaacuccaaguagacgagcuagguaaaaauauccaugaaacacgcucgcgaaaacguccaaacaucggcuga

SEQ ID NO: 7226 - RNA, 3012 nt, Artificial Sequence
  Cas9 variant
augcgcauccugggcuucgacaucggaaucaacagcaucggcugggccuucguggagaacgacgagcucaaggacugcgggguccggaucuucaccaaggccgagaaccccaagaacaaggaguccuuagcgcugccacgccgcaacgcccggucuucacgccgccggcucaagcgccggaaggcccgccugaucgccaucaagcgaaucuuagccaaggagcucaaguugaacuacaaggacuacguggcggccgacggcgagcugccuaaggccuacgaggguagccucgccuccguguacgagcugcgcuacaaggcgcugacccagaaccucgagacaaaggaccuggcccgggucauacugcacaucgccaagcaucgcggcuacaugaacaaaaacgagaagaagaguaacgacgccaagaagggcaagauccucagcgcccugaagaacaacgcgcugaagcucgagaacuaccagagcguaggggaguacuucuacaaggaguucuuccagaaguacaagaagaacacuaagaacuucaucaagauaaggaacaccaaggacaacuacaacaacugcguccuguccagcgaccuggagaaggagcucaagcugauccuugagaagcagaaggaguucggauacaacuacuccgaagacuucaucaacgagauccucaaggucgccuucuuccaacgcccccugaaggacuucagccaccuggugggggccugcacauucuuugaagaagagaagcgggccugcaagaacuccuacagcgccugggaguucguggcgcucacaaagaucaucaacgagauaaagucccuggagaagaucucuggcgaaauugucccuacccaaaccaucaacgaggugcugaaccucauccuggauaagggguccaucaccuacaagaaguuccgcagcugcaucaaccugcacgaauccaucagcuucaagagccugaaguacgacaaggagaacgccgagaacgccaagcugaucgacuuccggaagcugguggaguucaagaaggcccucggcgugcacucccugucccgccaggagcuggaccaaaucuccacgcacaucacccucaucaaagacaacgugaagcugaagacgguccucgagaaguacaaccucagcaacgagcagauuaacaaccugcuggagaucgaguucaacgacuauaucaaccucuccuucaaggcccugggcaugauccugccgcucaugcgggagggaaaacgcuacgacgaggcgugugagaucgccaaccugaagcccaagacugucgacgagaagaaggacuuccugccggccuucugcgacagcaucuucgcccacgagcuguccaaccccguggugaaccgcgccaucagcgaauaccggaagguccuaaacgcguuacugaagaaguacggcaagguccacaagauccaccucgaacuggcccgcgacguggggcuguccaagaaggcccgggagaagauagaaaaggagcagaaggagaaccaggccgucaacgcgugggcccucaaggagugcgagaacaucggccugaaggcaagcgccaagaacauccugaagcucaagcuguggaaggagcagaaggagauuugcaucuauuccggcaacaagaucagcaucgagcaccugaaggacgagaaggcccucgagguggaucacaucuacccguacucccgcagcuucgacgauuccuucaucaacaaagugcuggucuucaccaaggagaaccaggagaagcugaacaagaccccauucgaggcguucgggaagaacaucgagaaguggucaaagauccagacccucgcccaaaaccugcccuacaagaagaagaacaagauccuggacgagaacuucaaggacaagcagcaggaggacuucaucucccggaaccucaacgacacccgcuacaucgccacgcugaucgccaaguacaccaaggaguaccugaacuuccuccugcugagcgaaaacgaaaacgccaaccucaaguccggcgagaaggggagcaaaauccacguccaaaccaucagcggcauguugaccuccguccugcggcacacgugggguuucgacaaaaaggaccgcaacaaccaccuccaccacgcgcuggacgcuaucaucguggcguacucgaccaacuccaucaucaaggccuuuagcgacuuccggaagaaccaggaacugcucaaagcacgcuucuacgcgaaggagcugacuuccgacaacuacaagcaucaagugaaauucuucgagcccuucaagagcuuccgggagaagauccuguccaagaucgacgaaaucuucgucagcaagccgccccgcaagcgagcccgccgggcccuccacaaggacacauuccacagugagaacaagauaaucgacaaaugcagcuacaacucaaaggagggccugcagaucgcccugagcugcggucgcgugcggaaaauugggacgaaguacguggagaacgacaccaucguccgaguggacaucuucaagaagcagaacaaguucuaugcgaucccaaucuacgccauggacuuugcccucggcauccugcccaacaagaucgugaucaccgggaaggacaagaacaacaacccgaagcaguggcagaccaucgacgaguccuacgaguucugcuucagccuguacaagaacgaucucauccugcugcagaagaagaacaugcaggagcccgaguucgccuacuacaacgacuucuccaucagcacguccagcaucugcgucgaaaagcacgacaacaaguucgagaaccucacuagcaaccagaaacugcuguucucuaacgccaaggagggcagcgugaaaguggagagucuugggauccagaaccugaaggucuucgagaaauacaucaucacgccccugggcgauaagaucaaagcggacuuccagccccgggagaacaucagccucaagaccucaaagaaguacggccugagauga

SEQ ID NO: 7227 - RNA, 3012 nt, Artificial Sequence
  Cas9 variant
augaucgaugaaagccuaacauucggcaucgaccucggcaucggcaguugcggcugggcaguacucagacgaccauccgccuuuggccggaaaggcguaaucgagggaaugggaagcuggugcuucgacguacccgagacgagcaaagagaggacacccacaaaccaaauacgaagaaguaaccgguuacuccgcagagucauaagacgacgacgaaaucgcauggccgcgauccgacgacugcuccacgcggcgggccuccugccgagcaccgacagugacgcgcuaaagcgccccggacacgacccgugggaacugcgugcgcgcggccucgauaaaccgcuaaaacccguagaguucgcgguaguacuaggccacauagccaagcgcagaggauucaaaagugccgcgaaacgaaaagcgaccaacauuucaagcgacgacaagaaaaugcucacagcucucgaagcaacccgugaacgccucggcagauaccgaaccguaggagaaauguuugcacgagacccggacuucgcgagccggcgaagaaacagggaaggcaaauacgaccgaaccaccgcccgagacgaccucgaacacgaaguccacgcacuauucgcagcucaaagaaggcuggggcaaggguucgcgagccccgaacuagaagaagcauucaccgccagugcguuccaccaacgacccaugcaagacagugaacgccuaguaggcuucugcccauuugaaagaacggagaaaagagcagcaaaacugacccccagcuucgaacgguuccggcuccuagcucgacucuuaaaccuacgaauaacaacgcccgacggcgagaggccacucacuguagaugaaaucgcccuggugacaagagaccuaggaaaaacggccaaacuaagcauaaaaagaguacggacgcucauagggcucgaagacaaccaaagguucacaacgauuagaccagaggaugaggaccgagacauaguugcacgaaccggaggggcaaugacggggaccgcgacacuacgaaaagccuugggggaggcccucuggacagacaugcaagaaagacccgaacaacucgacgcaaucguccagguauugucauucuucgaggcaaacgaaacaaucaccgaaaaacugagagaaaucggacucacacucgcaguacuagacgugcuacucaccgcacuagacgcaggcguguucgccaaauucaaaggggcagcacacauauccacaaaggcagcgaggaaccuacugccucaccuagagcaaggccgaagauacgaugaagcaugcaccauggcaggauacgaccacgcagccucgcgacucucgcaucacggccaaaucgucgccaaaacacaauuuaacgcccuaguaacagaaauaggagagagcaucgccaacccaauagccagaaaagcacugauagaagggcugaaacaaauuugggcgaugagaaaccacuggggacucccggggagcauacacgucgaacucgccagagacguagggaacagcauagagaagaggagggaaaucgaaaaacacauagagaaaaacacggcauuacgcgcgcgagaaagaagggagguccacgaccuccuggaucuggaagacguaaacggggacacauugcuucgcuaccgccuauggaaagaacaagggggaaaaugccuauacacuggcaaggccauacacauacgacaaaucgcagcaaccgauaacagcguacaaguagaccauauacuacccuggagccguuucggagacgacaguuucaacaauaaaacgcuaugucuagcaagcgcaaaccaacagaagaagcgcagcacccccuacgaauggcuaucgggacaaacaggggacgccuggaacgcauucguacagcgaaucgaaacaaacaaagagcugcgaggauucaagaaaagaaacuaccuacugaaaaacgcaaaagaagcagaggagaaauucagaagccgcaaccuaaacgauacaagauacgccgcacgacuuuucgcagaagcagucaaacuacuauacgcauucggcgagcgacaagagaaaggaggcaaucggcgaguauucacaaggccgggggcacucacggcagcacuacgacaagcauggggcgucgaaagccucaagaaacaagacgggaaacgcaucaacgacgaccggcaccaugcacucgacgcccuuacaguagcagcaguggacgaagccgaaauccagagacucacgaaaucguuucacgaaugggaacaacaaggacuaggcagaccacuuagacgagucgagccacccugggagagcuucagggcagacguugaggcaaccuacccagaaguuuucguggcccgaccagaacgcagacgcgcacgcggugaaggacacgccgccacaauaagacaaguaaaggagcgcgaaugcacucccaucguguucgagagaaaagcggucucaagucuaaaagaagcagaccucgaacggaucaaagacggcgaacgcaacgaagcgauaguagaagccauacgaucauggauugcgaccggccggccagccgacgcaccaccccggagccccagaggagacaucauaacuaaaauccgacuagcaacaaccauaaaagccgcagugccaguacgaggaggcacagccggacgaggagaaaugguaagagcugacgucuucucgaagccgaaccgucggggaaaagacgaaugguauuuggucccaguauacccacaccaaauaaugaauaggaaggcauggccgaaaccaccgaugcgauccaucgucgcgaacaaggaugaagacgaauggaccgaggucgggcccgaacaucaguucagauucucgcucuaucccagaagcaacauagagauuauaaggccgagcggggaagucauagagggauacuucguuggacuccaccgaaacacaggagcccucauaccgacacccgugggaccagacagcuacguuaucgccuga

SEQ ID NO: 7228 - RNA, 3024 nt, Artificial Sequence
  Cas9 variant
augaaggugcugggcuucgacaucgggaucaacagcaucgggugggccuucgucgagaacaacgagcucaaggacugcggggugcgccuguucaccaaggccgagaaccccaagaccaaagagucccuggcgcucccgagacgcaacgcacggagcucccgcgugcgacugcgccggcgccggagccgccugcucucccuuaagcacaucaucagcaaggaguucggccugcacuacgaggacuacaucgcccucgacgggaaccugcccaaggccuacacgggcaagaucgaguccaucuacaagcugcgguacgaggcccucagccaggcgaucuccaaggaggaccuggcccgcgucauccugcacauugccaagcacaggggcuacaugaacaagaaccagaagaccagccaggacuccgagaagggggcaauccucagcgcgauaaaggagaacuccaacaagaucaagcauuaccagaccgccggcgaguacuucuacaaggagcuguucgagaaccugcgcgacgggaccaaggaguucaagaacauccggaacaaggccaugaagaacgagaagacgggcaauauggagagcaccuacuacaacaccauccucgccuccgaccuggagaaggagcugaagcucauccuggagaagcagcaggccuaucacaacuacagcgauaccuucaucaaggaggugcuggagaucgcguucuaccagcgcccccucaaggacuucucccaccugguggggagcugcacguucuaugaaaacgagaaacgggccugcaagaacuccuacagcgccugggaguucaucgcccugggcaagaucaucaacacccucgaaagcaucaagaaggacaccggcgagaucuucuccaacgagaucaucacccagauccugaaggagguccuugacaaggggagccucuccuacacgaagcugcgcaagaugaucaaccuggacgaaaaggugaaguucaagggccucaaguacgacaaggaggggguggagaagaccaaccugaucgaguucaagaagcugaaggaguucaagaaagcccucggcgagcacaaccuggagcggaagacccuggaugagaucgcgacccacaucacgcucaccaaggacgagaaccagcugaagaagcagcuggagcaguacgcccucagccaaaaccagaucgaugcccuggccgagcuggacuucaacgaccacaucaaccucuccuucaaggcccuguacgagauccugccucucauggagaagggcaagcgcuacgacgaagcgugcaacgagcuggggcugaaggccaagaccagcaaccagaaguccgaguuccugccggccuucugcgacagcaucuucgcccaagagcucaccaaucccaucgucaaccgggccaucuccgaguaccgcaaggugcugaaccgccugcucaagaaguacggcaagaugcacaagauccacauagagcuggcgcgggacgcggggcugagcaaggaggcccgcaacaagaucgagaaggagcagaaggagaacaaggauaucaacgacaaggccgagaagacgugcaaggaguucggacucaaacccaacgcgaagaacauccugaagaucaagcuguggcgggagcagggggagaucugcgccuacuccggcaagaagaucaccaucgacgaccucaaggaggacaaagcccuggagguggaccacaucuaccccuacagccgcuccuaugacgacagcuacaacaacaagguccugguguucaucaaggagaaccagcucaagcugaaccagaccccguacgaggccuucggcuccaaccaggagaaguggagcaagauccaggugcuggcccagaagcuccccuacaagaagaagaaccggauccuggacgagaacuucaagaacaaggaccagaucgaguucaucucccgcaaccucaacgacacccgguacgcgacgagccucaucgccaaguacaccaaggaguaccuggaauuucugcccuuguccgacgacgaggacaucagccucaagagcggggagaaggguuccaagacccacguccagaccaugaacgggaugcugacaucggugcugcgccacgcauggggcuucucccagaaggaccggaacaaccaccuccaccacgcccuggaugccaucaucaucgcguacagcaccaacuccaucaucaaggccuucagcgacuucaagaagaaccaggagauccugaaggccaagcuguacgccaagaagcugaccuccgaggaguacaagaaccagagcaaguucaccggguucgagaaguaccgcuccaagauccucgagaagcuggacagcaucuuuguguccaagcccccgaacaagaacacgaagggcgcgcugcacgagcagaccuucuacucuuaccaggacauccucgaggaguacaagacccaggagggccugaagcgggcgcuggaaugcgggaagguccggaagaucggcaccaaguacguggugaacgaccggaugguccgccucgacaucuucaagaaggacaacaaguucuacgggaucccaaucuacacgauggacuucgcccugggcgugcugcccaacaagguggugaccaucgggaccgacaaggacaagaucaagaaggaguggaagaccaucgacgagacauacgaguucugcuucucccucuacaagggcgaccuggugcugauccagaagaaagagaugcaggagagcgaguuugccuauuacaacggcuucgacaucuccagcgccuccaucagccucgagaagcacgacaacaaauucgagaaccugacggaaaaccagaagcugcuguuccccaaggcgaaggagggggauguggaggugcggggcaucgggauucagggccugaagguguucaagaaguacauggucaccccgcuuggcgagauccaggagacccgcaccgaggcccgacagaacauccagccccgcaagaagcacgggcuccgguga

SEQ ID NO: 7229 - RNA, 3033 nt, Artificial Sequence
  Cas9 variant
augagcgacagcagcuauguccuaggccucgaccuaggcaccaacucaaucggaugggcaugcguuaggcugaacaaggggaagccagauggacuccuagcgcagggcgucagaaucuuugaagccggacuggaaauugacgccuacgggcgcggaaccccauugaacacagaacgccgcaacgcacgccaaaggagacgucugcacgaccgaagaaaaagacgaauacugaaggugcggcggauccugcaagaagcuggcaugcucccagcaaacaaaccggaccacaaagacgcagaauggaagaugcuacuggcacgcaaccccuaccgcuuaagagccaaagcccuagacgaacaaauagaccuaaaagaaauaggccucugcauauaccaauucgcacaccgaagaggauuucuaagcaacucgaaaauccucaagaaagacgacgacagaggaaaauuaaaagacgccacaaaggccuucgcugaagacauggaacaaaaaggcgcccgaaccuggggcgaauaucuaagucaccucgacccacacgaacagcggauacgcacgaacuacacacuuagagaaugguacaccuccgaguucgaccugaucugggaaaaacaacaauccuucuacccacacguccucacggacgaccuauacaagagagugaaagaagcacucuucuaccaacgcccccucaagagccaagcccaucugcuaggacaaugcgaacuagagccagggcggaagagggcaccguucgcccugcugauggcacaagaguuccgccuacuucaaagccugaaccaccuacgcgucguaagcuccacaggagacgaacggcuacuuaccgacgaagagagaaagcaagcccuggcccuccugcgcucgcgaggaaaccaaaaauucacaaccuugcggaaaguacucaaccugcgaggaaccaaauuuaaccucgaacgcggaggcgaaaagacaauccaaggaaacaacaccgcagcugcccucggcaaccucuucggagaagcaugggaccacuucucaagcgaacagaaaaaccaaauaguagaagaucgguuaaccauuggagauaccgaugcauugauccgacgcaugaagaaaacgugggguuuagacucgguaaccgcagaaauguucucagaaacagaacuagaagacggauacugcggauucucccgaaaagcacuagagaaacuacucccgcuacuugagcggggccacgcauuaauggaagcaguacaggcagcguaccccgacuaccagaaaaaccuuccgcgcacagacacgcugccgccccuggagaaccucagaaacccaaucgugcaacggacgcucuccgagcuccgacgaguggucaacgcgauaauaaaagaauacggcaaaagugacaaaauaagaauagaacuggcacgggauaugaaacaaacagccaaaaacagagaaaaauccugggaccgcaugcgcguaagagaaaggcaacgcaaggaagcagcaaagaaaauccucgaggaaacaggcaacccggcaccacgacgccacgaaaucgaaaaaguucuacuugcggaagaaugcaacugggaaugcccguacacagggaagcgcauaugcaugaacacccuuuuaggcgacgcaccccaauucgauaucgagcacaucauacccuucagccgcagcuucgacaacaguuucuccaauaaaacgcugugcgacgucaacuacaaccgaaacguaaagggcaacaagacacccuacgaauccgccagcgaaaccgaacacgaagaaauggucugccgaguaaaacgcuucacaggcgacuacaaagaaauaaaauuggacagauucaacacccgagagaccgacucacgagccgacuucauagaagaauuuagcacaagccaauuaaacgacacgcgauaugcaucccgccuagcaggagaguaccucgggaaacucuauggauccgaauggcguaagcacauccaaauagcaaaaggcggaacgacgaaguaccucagggacgccugggaucuaaaccgaauacugagcgacgguggaaccaaaucaagagacgaccaccggcaucacgccguggacgccgucgucguggcccucacaacaccacaaacggucaaggcccugagcgaugccaaccaacgagccccagaacaccgaagauacgcguucuccgauaugccauuaccaugggaaacuuucagacaagacguagaacaggcaaucaacagcaucacgguaagucacaaggucugcagaaaggcaaacggacagcuccauaaagaaacauucuacggccucauaaaggacagaaaaacaggcgacacuaggacaguauuaagaaagccgcuucacgaacugacagacaaggagauaaagcgcgccgaaaucgucgacucaagcauaagaaagcugauugaacaaaagcucaaagaccuggaccaacccccaaaaacagcauucaaggaccguaacaaccaccccuucauaaucgacaagaacggaaacaaacgcuucauacacaaaguaagaguauaccaggaugcgaagccagucaaaauagcagaaaacagacauguuaaacuuggagggaaccaucaccuagaaauauucgaggucauugacaagaaagggaaucccacauggaaaugcgagguaauuagccucuucgacacucgacaacgcgugaaagaaaaacgccccgucauaguccggcaagaccagaacggcaacccacuaaaauucucacugucuaucggagaagccguacagcuagacuggaacggcgggagagagacagcagugguucagaaaaugagcaaaaccccaaacacgguagaauacgucuucagaaaacauaacgacgcaaggaaagcagcagacaucccauacaaggaaacaauaacaguuaagucggacucagcacucuucgcauccaaccuccagaaaaucguaaucacccccacagggcucauuagacgcgccaacgacuga

SEQ ID NO: 7230 - RNA, 3033 nt, Artificial Sequence
  Cas9 variant
augaaaaaccgcaacguaauagguaucgacgucgggacaaacucgauaggaugggcgcuagucgaggaaaacgaaaacggacuuccgcaaucccuaaaagcagccggcguccgcaucuuccaagaagccgucgaagccaaaacacgcacccccaaaaaccacaaacgccgacaagcacgacuagcacgccgaguccucgcccgcagagcgagacgcaagcaaaggcuccaaaaccuucuccuuaaacacggacuauugcccggcggagucacggaccccguccaaagagaggccgcauucacuacacucggggaccccuaccaacuacgagccaaagggcuaaaccucccacuaggacuucacgaauuuggacgcguacuauuccaacucggagcccgacgaggauuccucuccaauagaaagacacgauacggacaccugaacaagcuagacgaacucgcugaucuuauagaggcggaagacgcagcgccaaaaacuggcgaugcagaagaagggaucauaagaaaagaaauaggcgaacuacgccaagcaaugagcgcggccgguucccgaacacucggagaauaccuagccggccuugcaaaggaagaacggaaacgaugcagacacacagagagggccaugcuagaagaagaauuugaaagacuauggaugguccaggcccgauuccacccagaacucuccgacgaacuaaaagugcagguacacaccgugauauucuuccaacgaccacuuaagucgaauagagcgucacucggcaaaugcucacuggaacccuccagaagaaaggcagcccgagcguggccagaagcccaacgcuuccgccuacuccaagaccuaaacaaccuagaaauacuugacccgcggacaggagaacuccgccgacuacgcgauacagaacgcgcaauacugcugaaugcccuugagcaacagaaauccaugaccuggaacgccguacgcaagaaacucgggcugcaccaaggggaaaaauucaaccuagaaaccggcgccaaggcagagacaggacucaaaggacuccaaacccucgcgagccuccacgcgauucuccaaggaugguucgacgaacuaggggacaaaagagaucuacucaucgaagaccucaucacuauagaagacucagcaggucucuaccgacgccuaagggagcacuggggguucgacagagagaccgcauuccgacuagcaacacucgagcucgaaccgggcuacgcaucacucucccuuaaagcaauacgcaaacuccugccacacaugggcgccggacaccguuacagcgaagcccgacaacaggugggcuacggauacgaaacagggcagagagaccuccaggagagacucggcgagccacccgacccccgcaaccccguagucgacaaagcccuacacgaacuuagacgcguuaucaaugcccugauucaccgauucggccgacccgacguagugagagucgaacucgcacgugaccuaaaacuagcgaagcgagacaaggagcgccuugaaaaacaaaacagggaaaaccaacgacucaaccgaaaagcagaggcagcuuuagccgaacucggacucggucagccaagcagggacgaccuuaucaaauaucgacugugggaagaaucaaaaggcuuaugucccuauaccggccgcgagaucggccuaagcacacuguuuuccccagaagucgacgucgaacacaucaucccauacucacgcugccucgacgacucguacaugaacaaaacccuaugcaugaccgaagaaaaccgcaugcaaaaaggcaaucgcacacccugggaagcauauggaggagauccagcacgauaugaacagauacuacaaugcgcucgcuacuuccccauggccaagcgaaagagauucuuggaacaaggcucagacuucgucgaccaauucauacaacggcagcuaaacgacacccgauacaucgcaaaacuagccaaggaguaccuagccgccgugugcaccaacguccaaguuaccaaaggagguaccaccgcgaugcuacggcaccauuggggccugaaccgguuacugggagaagacgacggccaaaaagaacgaggugaccacagacaccacgcccuggacgcagcgguaaucgccguuaccucacgcagccuauaccaaagacuagcccgcaucgcccaccagcgcgggcacgcgccgucacaacgcgguuucuacaucgaucccccguggcagggauaccaagcagacuuggcccaaacccucgcaggaaucgucgugagccaugcaacaaaccggaaacuaacaggagcacuccacgaagaaaccgcauacggccacaucccacacgucggauucgucuaccgaaaaacccuaaacaaagacuuuaaacuaggagacauagaagccaucuacgaccccucccuacaagagcuaguaaaagcccaccuggaacaccacggaaacgacccuaagcgcgccuucgcagagggcauccagugcuaccacaaagacggccacacacccauaaaaaggguacgcaucagagcgaaacagguaucagaaaaaggaaccuucagcauaagcgaccgggcgggucgcgccuacaaacaucacaaaaccggguccaaccaccacgucgaaauauuacgccaccgcgccacaggcaaaaucgaaccagucuaccucaccaccaaggaagccaccgagcgagccagaagaggaggagaaccagucauacaaagagaccacggcccagaaugggaguucauaauuagcuuaugcauaaacgauauggugcgacugggcgaaggaggacaagucgcauacuuccgaguccagaaaauagaagcuacaaacaaccgugucacacuucgaucccaccucgcagcaacacuugacgacgaagacaugaagguaaccacguccgucccaaagcuagcaguaaugccaggguuccaaaaaguccucguaaccgccgucggggaaguccucgaacuccacgauuga

SEQ ID NO: 7231 - RNA, 3033 nt, Artificial Sequence
  Cas9 variant
augaaaagaauggcagcaguaggccucaugccggcagaccccacagaagcgaaagcacuugaacuauuagaucccuacgcccuccgcgccgccggccuugaucaagcauuaccccucacacacuuugggcgagcgcuguuccaccuuaaccaacgacggggcuucaaaucgaacagaaaaacagacaaaggugacaacgaaucaggcaaaauaaaagacgcaacaaaacguuuagacgaggaaauggcuaucaaaaacgcacgcacauacggcgaguuccuacacaugcgaagaacaucggcaacagauccgaaaaacgucccaaccguccgcacgagacuaucaaucgcacggagagacaacgccgaaaaagaagaagcgggguacgacuuuuaccccgacaggcggcacuuagcggaagaguucgauaaacucuggaaagcccaggccggcuacucacccgauguguuaaccgacgaacugcgggacgaaauaucaguaaucauauuccaccaacggccccugaaaacaccugaaguaggacucugccuauucagcggaucucacggggugccaaagaaagacaaaaggaucccguccgcccacccgcucaaccaacgaagaauauuauucgaaacuauuaacaaccucagaguagccgcgcgcggcgaaccggccagaggacucacacgugacgaacgcgacgccauaguacacgcgcucgacaacaaagcccacaccaaaucucugucaggcaugagcaugaagcuaaaagcgcucggaaagguaauaaaguuacgaccagagcagucauucacgcuccaaacagcgaaccgagaaaccauagcaugcgacccaguacgcgcaagccucucccacccagauagauucgggccccgcuggagcauguuagacgcagacgcccaaugggacguaguacaacgcaucagagccguacagagugaagcagaacaugacgcacucgucaaauggcucauggccacacacggacucgacagagaccaugccgaauccaccgccaaggcaccccuccccgaaggcuacggcagacucggacucacagccaccaaacgcaucuuggccgcacucgaggcugacguaauaccauacuccgacgccgucaaagcaugcggauggcaccauagugacggacguacaggcgaaguccugacagagcucccauacuacggacaaauccuagacagacacguaauccccggaacguacaaugaaucagacgacgacgucacccgcuacggacgcauaaccaacccuacaguccacauaggacucaaccagcuccgccgacugguaaacaagaucaucaccguauacggcaaacccgacgagaucguagucgagcucgcccgagaccucaaacucagcgaagaccaaaaacgagauguccagcgcgacaucaagaaaaacacagaugcugcaaucgcacgaggagcaaaacucuccgaaaugggcguccccgauacaggugccaaccguauggucuuacgucuaugggagucgcuaggcgaugacgucaugacacggaacugcccauauucaggcaaacgcaucagcgccaccaugcuauucgacggaucaugcgacguagaccacauccuccccuacagccgaacacucgaugacggauucgccaaccggacgcuaugccuaaaagaguucaaccgccagaaaaccgacaaaaccccgugggaggcuuggggagacacacccgcgugggccacuaucgaagcaaaucucaagaaucuacccgccaacaaagccuggagauuugcacccgacgccauggaacgauucgaaggcgaaaacgacuucaccucuagggcccuaaaagacgcccaauaccuaagccgaauagcccgaacuuaucucgacgcccucuacgacggggccgacgggaaaagccacgucugggucguacccgggagacuaaccgaaaugcuacgccgacacuggggacucaacagccuccucccagacaaagacggagccgugaaagccaagaaccgaacagaccaccgacaccacgcaauagacgccgcaguggucgcagccaccgaccgaagccuaauucaacgcaucagcaaaauggcgcgcaaagacgaagucaauggcgcagaagaaguugcgcggucaguacccccuccaugggaaggcuuccgaacagacauagagacgcaacuagacagaaucaucauaagccacagggcagaccacggaagaaucgaccccgccgcgcgaaaagacgggcacgacagcacuucaggacaacugcauaacgacacagcauacggacuaggagagggaaacagugugguaucccgaaaaccccugcuaucccuaaaaucgaacgacauagaaguaacgacaaaaggcgccaacauaagggauguggaccuccagcgacaccucgagcgcaucacaagaggccucgacggcaaggcauuagaagcagcccuagcugaguucgcggccacggcgaaacuacccgacggaacggacaacccguacuacgggcuacgaagaguacggcuugaagaaacccuacaacaaggcgcaagagucgaaguaaaggaccgaaacggaaaaccauucaaggcauacaaaggcgacucaaaccacugcuacgaaaucuggcgaaugcccgacggcaaaguagucccccaaguaauaaccaccuacgaagcccaucaaaucgacguagagaagaaaccacacccagcggcaaaacgacuccuacgcauauuuaaaagggacaugguagcuaucgaacaagacgacaaagcaauuauuggauacguacaaucaaugcacgucgccaacggccuauucaucgccccucacacggaggccaacgcugacgcacgcaguagggacaaaagcgacagcuuccgcuuaauacaaaugagcgcugggccacucguaaaagccaacgcgcgcagggucuacguagacgaaaugggccgauuacgcgaccccggagcccccuccuga

SEQ ID NO: 7232 - RNA, 3039 nt, Artificial Sequence
  Cas9 variant
auggcaaacaugcgcuaccgacucgcacucgaccuuggcucaacuucgcucggcugggcaaugguccgacuagacgcccaaaacgaaaccugcgcggugaucaaagccggcgugcgcauauucucugacgggcgcaaucccaaagacggcucgucacucgcagucucccgacgagaggcacgggcgaugcggagaagacgagaccgccuccucaaacgcaagacccguaugauggcaacccugaugaaacacggguucuucccacaggacgaagcagcgcgccaagcccuaguaaacaaggaacccuucgcccucagagcgaagggauuagaucacgcacuacuaccagaggaguucgccagagcacuauuucacaucaaccaaagacgcggcuucaaauccaacagaaaaacggacaaaaaggaaaccgacagcagcgcacugaagaaagccauaggccaacucagagaagcgaugcaagcaucggggugccgcacagucggagaauggcucugcgcacgacaucaacagggacuaagcguaagggcacgcuaucgcgagaaccgaauaacaaaagacgauggaaaaacaaaaaucgagaagucauacgaccuguacaucgacagagccaugaucgaagcagaauuugaugcccuuugggcgaaacagucagaacucaaccccgaauuauuccacgaaaccgcccgugccgaacucaaagacugccuccuccaccaaaggccucuaaaacccgucaaaccaggcagaugcacccuacucccagacgaggaacgcgcgccccuagccuuacccagccaacaacgcuuccgcaucuaccaggaaguaaacaaccuccgacugcuccgcgaaggccugaacgaagaaccacugacacuaacacagagagaccaacucauacaagcccucgagaccaacccgaaacgaucuuucacacaaauccaaaaacuccucggcuucagcggccaauucaaccuccaggacgacaaacgcacagagcuuaaagguaauagcacaagcgccaugcuuagcaaaaaggaauuuuucgggagucaauggcucagcuucgacgaaacgcaccaagacgagaucgugaugcagcuaguauccgaagaaaacgaagcacgacuaaucgcauggcuccaagcagaaaccggagucgacgaaauaaccgcggaaagaaucgccaauacacccuuagccgagggcuacggcucccuaagcgcaaaggcccucgaaaagaucuuaccagcacuacgagccgacguaaucaccuacgacaaagcaguacuagccgcaggcuucgaccaccauucacacaucucgcacgcggccacgggagaaauacugccagacuuaccauacuacggccaauaccuccaacgacacgucggauucggcacgggaaagcccgaagacccggccgagaaacgauacggcaaaaucgccaaccccacaguacacaucggacucaaccaagucagaacagucguaaacgcacuaauaaaaagauacggacacccgagcgaagucgucguagaauuagcccgagaccucaaacaaucacaagagcaacgcaaggaggaacaggcccagcaagcgaaaaaccaacgacgcaacgagagaaugaggcaagacauugccggacuccuaaauacaucaacagaacgaguccgcgcccucgaucugcaaaagaugauacuaugggaagaacugagcuucaacgucgcggaucgacggugcccauacagcgggguacaaaucuccgcccaaaugcuauuuagcgaccaaguugaaaucgaacacaucuuacccuucucccaaacacuagacgacucccuaaacaacaaaaccguagccaugaggcaggcaaaucgaaucaaaggaaaccgaacgccagcggaagcugcagccgacuuugccgcgcaaggauggccgguagaggacaugcuccacagagcaucccucaugccgaaaggaaaacgauaccgguuugcacaagacggaauggcacaguggcuccgagaggacaaaggauuccucgcgcgcgcguugaacgacacgcgacaucuaucacgagucgcgcgugaauaccuaucacuuguaugcccacaaggaacccgaguaauacccggucguaugacagcaaugcugcgagcuaaauucggauuaaacgacauacugggacugaacggggagaaaaaccggaaugaccacagacaccacgcugucgacgcaugcgucauagccgucacggaccaauccaugcuacaaaaauucgcaaaagccuccgcaucagccagagaaaaacaacuaaacaaacucgucgaaagcaugccccucccgugggacagcuaccgcgaccauguccaacgcgccguagaaagaaucuggguaucacacaaacccgaccacggucacgaaggcgccaugcacaacgacacagcauacggacuccugggaggaggacacguccaagucagaaagagaauggacgguguaagaacgagagaaacagcggcgcugaaagugauagaguucgccgaccgccaagcacacccacgacacggccuccuaccaaacggagaacccaugcccuacaaaggcuacaagggcgacuccaacuacugcauggaaaucguuagaaacgacaagggcaaaugggaaggcgaagucgucucgaccuucgaagcauaccaacucguccgccaacacgggcuagcuagacugcgacauccagcccuaucgguaagcgggcggccccuuguaaugagacuacucagaaacgacaccuugcgcguaauccacaauggggagcaacgcacgguccggauaugcaagaugacggcggaaggcgucauagcccucgcggacacgacugaaucaaacgucgacgcccgaacacggacgaaggaccuaucauacaucuucaaaacagccggaucacuccaaaagucaaaaggacgacgcgucgcgaucuccccgagcggcgaaaugaaagaccccggauucuucgauuga

SEQ ID NO: 7233 - RNA, 3051 nt, Artificial Sequence
  Cas9 variant
auggaaguuuucgucgacgucucagcacgccagcuaggcaucgaccuaggaauaggaacaugcgggugggcgcugcuagcugaagacucacuaauagcacuaggaacgcgaacauucgacgugccagaaaccgauaaagaaagaaucccgacaaaccaaaucagaaggcaagcccguggcaugcgcagaguaauagacagacgacgccaaagaaugaacgcggugaggaggcuacuggcagaccacggccugcuagccgacggcggaaaacuaggucuagcgaccgugcgccuagaccccuggcaggcccgagcugaaggccuagacagacuacuuucagccggagaacucgcaguggcgcuaggccacaucgccaaacaccgcggauuccgcucaaacuccaaaagagacagaggcgccaacgcgcccaaagaaucaucagccaugcucggcgccauagcacaaacaggagagcgacuccaacauuggcgcacgguaggagagauguucuggaaagacgaguucuaccaaaccaggaggagaaaccgcgacggagacuacucacgcaccguccaaaggcuagaccucgaaacggaaguccacaggcuccuugcagcccaacgacggcucggcaacccacucgccaccuucgaccuagaacaauccuucauagacgucgcguucuuccagaggccacuggccgacucagacgacaaaguaggaccuugcccguucgagcccuccgagaaaagagcagcacgacauagccccagcuucgaaagguucagacugcucagccgacuagcggccuuacgacucaguagcggcgccggcgaacggccacuaagcgaugcagaguucgcugcagccugcgcagacuuuggacgacuccaggguuucagcuucaaaagacuccggcaacacuuaaaacucgacccaucaaucagauucgccggaaucgcgcccgacgaagaagguaaaagggacgugguggcacgaagcggcgaagccaccccaggaagcgcagcccuacgacacugccuaggagacacggugugggauaacaugcucgggaccagacccgcacuacuggacgcgaucgcagccauacucacguucagagacgacgccgacagaauagccgaaggccuggcaggacugggaauagaagaacccauacuagacgcccucauggauggaguaaggaacggaaguuucggcaaauucaaaggaccaggacacaucucagcuaaagccuguagagcccuccugccacacuuggcaagaggacgcguauacagcgaugcaugugccgacgcgggcuacgaccacucccgccaaaccgagacuaaccuagacgacaucaggaacccagucgccagaaaggcccuaggugaggcauugaagcaaauaaaaaucauaauacauacacacggaagaccgacugcaauacacguagaaauggccagagacaucgggaagagugcagacgaaagagaugaaaucaagaaaggcaucgacaaaagaaacucagaaaaagauagagcccggcaacaauuccacgaaauggugggaacucccgccgccggagcagaagaccuacuaagguucgaacuauggaaagaacaaaacggauggugccuguacacaggaagagaaauacccaucgacgcgcuaguauccuccgacaacagaauccaagucgaccacauccuucccuggucgcgaagcggcgacgacuccuacauaaacaaaacgcucugcuuuacggaagcaaaccaacacaagaaaggaaugacaccaugggaauggcuacacgaugaccccgaacgaugggaaaaauucgcaagaacagucgaaggaugcaaaacgaugaaaggcaggaaaaagcgcaaucuacuucuccgggacucaagcagacuggagaaagaguuccgaagucgaaaccucaacgacacacgguacgcaugcagguuacuauuagggauucucaaacacacauauccagacauagucguagccgcaagacccggccccuugacggaccgacugcgccgagccuggggacugcaaagucuaaagaaacacgaagacggaacacgaaaagacgacgauagacaccacgcacuagaugcagcaguagucgcagcaaccagccaauccaugcuccaacgcuugaccacacuauuccaaaaagccgaacgggaaggaggccggcgagacuucguaggacuagaacccccguggccgggauuucgcgcagaccuagaagccaagcucgagggcgucgugguuagccgcgcggaacggagacgagccaggggcgcaggccauaaagacacaauccgcgccauuggagaaggagacgcuggucccgucguguacgagcgcaagcccguagcagcacucacagaaaaagaucuggaucgaguaaaggaccccgagagaaauaaggucuuaauugaaaaccuccgccaguggauagcagcaggaaaaccaaaagacccggacaaggcaccccgauccccaaaaggcgaccccaugacaaaaguaaagcuagucaccacagacgauguaagaauccuaguccggggcggaacagcagaccgcggcgacauggcacggguggacgucuuccgacaggcggacccgaaaggacgcuggcgauucuuccucgucccgguauauccccaccaaguauucgacccaacagacuggccacaacccccaaaccgcgcuguagucgcauacaaacccgagaaagaauggacaguaaugggacccgaccacgaguuucucuggagccucuaccccuucucguggaucgccguagaaaaagccgacggcacgagaauagagggauacuuccgaggcaugcaccggucaaccggagccauaagcauaagcccacaccacagcaaaagccuagccuccacgggcauaggcgccaaaacacuggccucguucaggaaauucgcaauggacagaaugggcaaccuaagcgaaaucgaaagagaaguaaggaccuggcauggaguagccugcacguga

SEQ ID NO: 7234 - RNA, 3054 nt, Artificial Sequence
  Cas9 variant
augcguguugacucccuagggcgaugccucuccgacgaagagugggcgcgcgucaucuaccaccuaugcaagcaccgcggcuuucacuggaucucccgcgccgaagccaaacaaaccgagggcgacucaaaaagcgaaggaggcaagguaaaacaggggcuagccgggaccgcaaaacuaauggacgaaaaagguuaucgcagcgcggcugaaaugguauuggccgaauuuccggaagcccaacggaacaaacaaggagaauacagaaaagcacucagccgagagcugcuagccaaagaacucgcacuacucuucgcacggcaacgcgucuucggcaacagacacgccacggacacccucgaaaccgcaauacucggaaacucagacaagaaauccggccuauuuuggcaacaaaaaccggcucucgcuggcgcagaccuacucaagaugcuaggcacuugcaccuucgagaaaaacgaauaucgggccccaaaggcaucauucaccgccgaacgacacguauggcuuacccgacuuaauaacuugagaaucgucacggauggaauuacacgacaacucaccgaacaagaacgccagcuuguccuaccgcuaccauacagacaagcaggcgaucucaccuacaaacaacucgguauggcacucaccaaagcaggccuccucgaggccggcugcuucaaauucaucggccuugccuacccaaccgaagcucaaaaagcagaaggcaagaccaaagaccccgaaucagcaacacucgucaaaaucccagccuggcaagaguuacggcaaacucucaacaaagcaucucuaaacgacgagugggagaaacugucgggagacgcccugugcggccaacccgaaaucuuugacaagaucgcauggauccuauccgucuacaaagacgacgacgaaguaagaaccgaacuagccaaauuagugcucccaaacccggagggccucaccgaagcgcuucucaacauccgcuucgauaaauuccaugcucuaagccucaaagcacuacgcgccaucgucccccacauggaaaaagggcuacgcuacgacgaagccugcgugcaagccggcuaucaccacucccagcuacacaagaucggugaaggagaacacaaauaucuacccccacucuacgacggccgagacggcgacggacguaugauauucgcugaagacgccgacauuccgcgaaacccagucguacucagaucacucaaccaagcgcgcaaaguuguuaacgccaucauccggcgauacggcuccccgagcgcagugcacaucgaaauggcccgcgacuugucacgacccuucgacgaacgaaauaaaaucaagaaagaccaggacgaguaccaagcgcgcaaucaaagggaccgcgaacaauucauagaacucuucggucaucccccuaaaggccuagaguucgaaaaauggagacuguaccgggaacaaaacggccaaugcgccuacagccaaaaaccgcucgccucauccggggacgucgccgaaaucuuccuagacggcucgacugaaaucgaccacgcacuccccuauucacgcagcuucgacgacuccaaaaacaacaaaguccuagugcuaaccagagaaaaccgagauaaaggaaaucgcacuccuuacgaauaccuagggggagcagaaaacuccgagagauggcaacgguucuucuccuucgucgaaagcaacaaagccuaccgacucgcaaaacgcacccgacugcuucgcaaagacuucggggccaaagaaagcgaagaguucagagaacgcaaccucaacgacacuagguacguaugccgguucuuuaagaacuacguugaacaacaccuaaaauuagcagaagguucagaggcaaaaagaugugugguuguguccggccaacucacgaacuuccuacgcacacgcuggggccuacuaaaaauacgcagcgacucggaccgccaccacgcacucgacgccgcagucguagcagcgugcucgcacuccaugguacaacgcuuaagcaacuacucgagaacccgcgaacucgaacaaguccgagacgguuucguuaacauugaaaccggcgaaauaguaaaccccgcgaugcaccaacaguugcgagaacacuuccccgacccauggcccuacuucaggcacgaacuagaagcccgauuaaagaucgacuccccugcacuccuacgagaagaaauggcaagacuuucaucauacacagaagaagaauuagccgcgcugaagccccucuucguaagccgggcgccgcaaagaagaaacgggggcgcagcacauaaagacacuaucuacggacaaccagaaaaacuuaaaaagaacgguuccgucucacaaaaagucgcacucgccagucucgcccuaaaagacauagaccuacuagcagacccgcacaggaacgcgaaacuguacggcgccauccgugaaagacuagaagcccacggcggaaaaggagauaaagccuuccccgcaaccaauccacuacgcaagcccgacaaggaagguaaccccaccggaccaauaguccgaaccgucaccaaaguuaucgacaaacuuucaggcaucccaguccgcggcgggauagccaaaaacgacaccaugcuaagaguagacgucuucacgaaagcggggcgcuuccaccuagugccaguauacguccaccaccgcgucaccggccuccccaaccaagcaauaacacgagguaaagacgaaaaccaaugggcuaucaucgacgacaccuucgaauggcgcuuuucccucuacccuaacgaccuaguacaaauacgccugaaagacgagacccaccuuggauauuaugccuccaccgaccgcuccacaagcuccauauccauaugggcacacgaccgaaaccaauccguuggaaaagacggccugauacgcuccaucggcgucacaacagccaaggacaucgaaaaauuccacgucgacacccucggaaacgucuacccagccccaccggagaaacgacgcggccucgcauga

SEQ ID NO: 7235 - RNA, 3066 nt, Artificial Sequence
  Cas9 variant
augaggcgccggagagacagauucaagcaacgacaagccgcgcugcugaaacaccuggcaggcgucggccuauucccagcggacgaagcggcaagaagggagcuagcaggacucgacccuuacgaacuaagagcaagagcgcugcacgaagcacuaccacuuaaccacauaggacgcgcacuauuccaccuaaaucaaaggagagguuucaaaagcaaccgaaaaacggauagaggaaaagcggacgacgaagggaaaauaagacuaggaguagccagacuccaagaggccaugcaugagaaagggagugcaacucucggagaguuccugcacggaaggagggcggccgccacagauccaaaccaaauaccaagugugcguaccagacugagggcagaauccggggaaggagcacgcggagacggauacgacuucuaccccgacagacgaaugcucgaagacgaguuugaagccaucugggaaagucaacagguacaccacccggcgguccuuacagacgaaaucaaacagagauucuuugagguaauauucuaccagcgaccacucaagcaaccggaaaucggcacaugcacgcugguagccggagaacgccggcuaccaaaggcacacccacucuuccaaaaacgacgacuauuagaagaacugaacgcgcuccggauagucuggcccggagugcaggccgaacugcuaucgcgagaacaaagggaccuggccuaccugaagcuaaaagacaagcgagcaguaagguucgagagucugcggaaagcacugaaauuagaccccgacgcccgauucaacaaggaaucagaaaaucgaagcgaacuaaaaggcgacgaagucgcagcagaacucggagccaagagcagauucggaggcagauggggccauacggcgccggcagaccaaugggagaucguauccagaauacaagcgcuagaaagcgacgaugacgaggcacaauucugcgucuggcuaagcgaaagauacggacuagacucggagcaggcaagagcaguagcggcagcacggcuaccacagggauucggaagauuuggacuaaccgcaacgaccagacugauaaaagcacuccaagaugaaguaauaguauacucggaggccguccagaaaacaggccuaggacaccacagcgacuuucggaacggagaaguauuggcagagcuuccauacuacggcauagcacuggagagacauauaaugccgggaacgggagauccaggcgacagcgacgaaaugcguguagggcgcgugacgaaucccacagugcacauaggccuaaaucaacuacgcagagugguaaacagacucaucaaacgauacgggccaccgagacagaucgcgguagaacucgcacgagaacucaaacuggaugaccagcacaagcgcgagauaaacggacgaaaccggcaaaaccgggaagcagcagaacgaagaucccagaagcuaguggacauaggaaucgcggacaaaggagcgaaccgcgcacucuuaaaauugugggaggagcuuaacccagacaacgcccuagaccgacgaugcguauacacgggaaggcaaaucucgauagagauguuauucagcggagcgguagaaguagaucacaucuuaccauucgccgcaacacuagaugacagcaacgcaaacaaacuacucugccuacgcgaagcaaacagaaacaaaagaagaagaagcccguuugaagcauucggacaaggggcagacugggaagagaucgccgcacgggcagcacgccuaccaagagagaaaagguggcgauucgaacccgacgcgauggccagguucgacacagaagagaaauuccucgcaagacagcuggucgacacacaguaucuaucaaggcuggcaagagaauaccuaggaguacuauuuccagauaagggcgaagggagcggaaggguauggguaagcccgggaagacuaacagaaauguuaagaagaaguuggggacucaaccaccuccucccagaccacaaccucgggggcggcgcagaccaacccaagaaucgacgcgaccaccgacaucaugcgauagacgcaaucguagucgcgguaaccgacagacaccuacuacaagccauagcaagagaagcagggcagagggggcacgaagcggccaaccgaaugacagcagaccucccgguaccauggcccgacuucgaccgagacgugggccaagucaucagacagguaguagugagucacagagcggaccacggcacgguaucaaaagcgggagcggcaaaaggccaggacucaacggcgggacgccuacauaacgacacggcauacgggcucacggggcaaacagacgaaaagggaaacacaauaguagucaggcggguaccgcugacggcacuuaagaaaccgacgagcauagaagccgucagagacgacgaacuaagaaaagcacuaucaguauggacaaggggguaugauggcaaagcguucgaggcccgcuuaaguagauucccagaacuaggaccccuacaauucaggggaauacgacgugucagaguaguggaaccacucacuguaauaccaauaagagacagcagcgggagaguauauaaaggauauaagggagacagcaauuacagauaugacguuugggaacucaaagacgggaaguggguggccgaaguagugaguauguucgacgcgcaucagagcaguuggacaaguccgguaagacgggaaaauccaacggcccgaaaaguacucagccuacagcagaacgacauagucgcaauagagccggaagggaaagaaagggagcuaaugagagucgcacagcuccgacaaggagggcaaauaacacuggcagcaugccacgaagcaggggaccucaagcggagagacgcagaaagcaacgagguagacccuuucaaauauuucucgcccaccgcgggcggucugaaaagagugagggcaaggcaagucagaguagacgaacucgggaggguacuggauccaggguccagagacagagagcgcggggcggcauga

SEQ ID NO: 7236 - RNA, 3066 nt, Artificial Sequence
  Cas9 variant
augaaguacacccugggccucgacguggggaucgccagcgucgggugggccgugaucgacaaggacaacaacaagaucauugaccugggggugcgcugcuucgacaaggcggaggaguccaagaccggcgagagccuggccacggcccggcgcaucgcccgggggaugcgccggcgcaucucccggcgcagccagcggcuccgccuggucaagaagcuguucgugcaauacgagaucaucaaagacuccagcgaguuuaaccggaucuucgacaccucccgcgacggcuggaaggaccccugggagcuccgguacaacgcccugagccgcauuuugaagccguacgaguuggugcagguccugacccacaucaccaagcggcgcggcuucaaguccaaccggaaggaggaccugagcacgaccaaggaggggguggugaucaccuccaucaagaacaacagcgagaugcuccgcaccaagaacuaccggacgaucggcgagaugaucuucauggagacccccgagaacuccaauaagcgcaacaagguggacgaguacauccacaccauagcgcgggaagaccugcugaaugagaucaaguacaucuucagcauccagcgcaagcucgggucgcccuucgugaccgagaagcuggaacacgacuuccugaacaucugggaguuccagcgccccuucgccagcggcgacucaaucuugagcaagguggggaagugcacgcugcugaaggaggagcuccgggccccaaccuccugcuacaccagcgaguacuucggccugcugcagagcaucaacaaccucgucuugguggaggacaacaacacccugacgcucaacaacgaccagagagccaagaucaucgaguacgcgcacuucaagaacgagaucaaguacuccgagauccggaagcuccuggacauugagcccgagauccucuucaaggcccacaaccugacccacaagaaccccucgggcaacaacgaguccaagaaguucuacgagaugaaguccuaccacaagcuaaagagcacgcugcccaccgacaucugggggaagcugcacucuaacaaggagucccuggacaaccucuucuacugccuaacgguguacaagaacgacaacgagaucaaggacuaccuacaggccaacaaccucgacuaccugaucgaguacaucgccaagcugccgaccuucaacaaguucaagcaccucagccuggucgccaugaagcgcaucauccccuucauggagaagggcuacaaguacuccgacgcgugcaacauggccgagcuggauuucaccgggagcagcaaacucgagaagugcaacaaacugaccguggagcccaucaucgagaacgugacgaaccccgucgugauccgggcccugacccaggcccgcaaggugaucaacgccaucauccagaaguacggccucccguacauggucaacaucgagcuggcgcgggaggccggcaugacccgccaggaccgggacaaccugaaaaaggagcacgaaaacaaccgcaaggcccgggagaaaaucagcgaccugauccgccagaacgggcggguggccuccggccucgacauccugaaguggcgauugugggaggaccagggcggacggugcgccuacagcgggaagcccauccccgugugcgaccuccugaacgacucccugacccagaucgaccacaucuaccccuacagccgcuccauggacgacagcuacaugaacaagguccucgugcugacggacgagaaccaaaacaagcgguccuacaccccguacgaggucuggggaagcaccgagaagugggaggacuucgaggcgcgcaucuacagcaugcaccucccccaguccaaggagaagcggcugcugaaccgcaacuucaucaccaaggaccuggacagcuucaucucccgcaaccucaacgacacgcgguacaucagccgcuuccugaagaacuacaucgaguccuaccugcaauucagcaacgacucccccaagagcugcguggugugcgucaacggccagugcaccgcgcagcuccggucccggugggggcugaacaagaaccgggaggaaagcgaccugcaccaugcccucgacgccgccgugaucgcgugcgccgaccgcaagaucaucaaggagaucaccaacuacuacaacgagcgggagaaucacaacuacaaggugaaguauccccugccguggcacuccuuccgccaggaccugauggagacccucgccggcgucuucaucagccgggcgccccgccggaagaucacggggcccgcccacgacgagaccauccgcucccccaagcacuucaacaagggccugaccagcgugaagauuccgcugaccaccgugacgcucgagaagcuggagaccauggucaagaacaccaagggcgggaucuccgacaaggccguguacaacgugcugaagaacaggcugaucgagcacaacaacaagccccugaaggccuucgccgagaagaucuacaagccccugaagaacggcaccaacggggccaucauccgcagcauccggguugagacgcccagcuacaccggcguguuccgcaaugaggggaagggcaucagcgacaacagccucauggugcgggucgacguguucaagaaaaaggacaaguacuaccuggugccgaucuacgucgcgcacaugaucaagaaggagcuucccuccaaggccaucguaccccucaagccggagagccagugggagcugaucgacuccacccacgaguuccuguucagccucuaccagaacgacuaccuggugaucaagaccaagaaggggaucacggagggcuacuaccgcuccugccaccggggcaccgggagccugucucucaugccccacuucgccaacaacaagaacgucaagaucgacaucggcguccgcaccgccaucagcaucgaaaaguacaauguggacauccuggggaacaaguccauugucaagggcgagccccggcgcggcauggagaaguacaacagcuucaaguccaacuga

SEQ ID NO: 7237 - RNA, 3072 nt, Artificial Sequence
  Cas9 variant
augaagauccugggcuucgacaucgggguggccagcaucggcugggccuucgucgagggggacgagauccgcgacugcggcgugcggaucuucaccaaggcggaaaacccgaagaccggugaaucccucgcccugccgcgcagggaggcccgcggcgugcggcgacgguuagcccgccggcgcguccggcucaauacgaucaagaagaucauuuguaaggaguucgaccugcgucugagcgacuacaucgccgacgacggcgagcucccgaaggcguaccagaccaacaaggacaccaaguccccauacgagcugcgguacaaggcccugaacgagcgccuaucuaaggaggagcuggcacggguuauccugcacaucgccaagcaccgcggguacggcaacaagcacgcgaaggacggcgacgacaaggauuccggcaaggugaagaaggccaucggggagaacaagacccuacuggagcagaagggcuacgagagcgucggcgaauacugcuuccgggaguucuucaaguccaucaaggacaaggacggggagacccacaacauccccagccaaaacauccgcaacaagaaggguaacuacgaucggugcgugucccagaagcagcuggaggacgagcucaagcugaucuucgccaagcagcgcaaacugggauucaacaaggaauuugaggacgccauccucgaaguggcuuucuaccagcggccgcugaaggacuucgacgacaagaucggcgacuguaucuucuucgacaacgagaagcgcgcgcccaaggagagcaucuccgccauugaguucgucgcccuaacgcgcaucaucaacacccucaaguaccugagcaagaccacgggcgaaguguacgagaaggagaucaucaacaagaucuggcagaagaucuuggagaacgggaagaugaccuacgccgagcuccggaagauacuggcccuggacuccagcguguucuuuaaggacaaagaccucgacuacacccugggcaucaaggaggcggagaagaucaaguucaucgaguucaagaagcugaucaaguucaagaaggcccucggguccuucgacggccuaagccgcgagauccuggacaauaucgccaugcagaucgccaucaccaaggaucggcagcgccuccuggagaagcuggaggucuucccauugaauaaggagcagaaggagaaccucucccagcugaacuucagcaaguacaucgaccucucccugaaggcccugaaccagauccucccuuucaugcgggaggggcgccgguacgacgaggcgaaggacgacgcaaagcugcaggaaaaggccaagaacacgaagaaggaggaguuccugccgccccucaaggaguuugaccugaaccugaccaaccccgugguggcccgcgcccucgcggaguuccggaagguccugaacgcccugcugaagaaguacggcaagguacacaagauccaccucgaguucgcccgcgacaugcggcuggacuucgacgagcgcgagcggcugaucagcauccagaaugacaacuucaacaagagacagcuagcugaggacuucugcaaggagcacggccuagagcccagcaacgcuaacauccugaagaucaagcuguggcaggaacagcaguggcacugcauguacuccggggagcugaucggcaucccggaccugaaggaccccaccaagcuccagguggaccacaucuaccccuacucucgguccuucgacgacagcuacaccaacaagguccuggugcgcgccgaguggaaccaggagaaggggaaccacacgcccuucgaggccuucggcggggauaagaacaagugggacaagaucguggcccuggcagagaagcucccgccgucaaagaagcuaaaccggucagagaaguccaagaaagacaaacuucucgaugagaaguucaacgacaaggagcugggcuuccuggcgcgcaacaucgucgacaccggcuacaucgcccggcucguggccaaguacaucgauauguaccuggaguuccugcccuuagaggagaaugagaacaccucgcuggcccgaggggagaagggcuccaagaagcacaucgggaucgugaacggccgccugaccagcgagguccggcacaacugggggcuagaccccaaggaccgcgacaaccaccuccaccacgccaucgacgcgaucgugaucgccuacaugaacgacaagcggaucaaggccuucgccgacuuccgacggcugaaggagcugaagaucaagcgcuacggccgagagaucacggaggacgaguaccaggagaagaagaaggagcuguccugcgccccguucgacgacuuccgcaaccggacccuggagaauaucgacaaaauauucgucagccgcccuccccggaagcgagcgcggggcacccuccacgaggagaccuucuacuccaucgacgacaagaagcugcugaaggccuacgggggcaaggaggggaugcagcgcgcccucagccugggcaagauccggcagauaggcacgaagaucgugaagaacgggaccauggugcgcguagacaucuucaaggacaaacggggccgcuucuacggggugccaaucuauaccauggauuucgcacugggagugcuccccaacaaggcagcggucuccgggaaggacaaaaacggccugaucaaggagugggccgaaauggacagcggauacgaguucugcuucucacuguucaaggacgaccucauccuggugcaacggaaagagaugcaggagcccgagcuguguuacuucgugucauucgacuccagcaacgcccagaucgacguccgcagccacaacaaccacuucuccgugcucaacgaaaaccagaagcugcuguucaagagcgccacccaggcggaggugaucggggaguccauuggcauccagaaccucaaggucuucgaaaaguggcacgugagcccccugggggaggugcggaaggccgaguucagcccccgcggcgaggccaaguuaaagacguccaagaagcgcaagaaguga

SEQ ID NO: 7238 - RNA, 3072 nt, Artificial Sequence
  Cas9 variant
augaaaaucuacagcuuugacaucggaguggcauccauaggcugggccuuuauagaaaacgaagugcuccaagacugcgguauccgaaucuuuacaaaagcagaaaaccccaaaaacggagccagucucgcgcucccccgaagagaagcacgugggguccggaaacgauuagcccgccgacgaggacgccucaacaccaucaaacaacuccucugcaaagaguucggccuucaacuggaagauuaucuuuccaacgacggagaacuccccaaagccuacacagcuaguaaagcaaauccgcuaaaaagccccuacgaacuccggacccucgcacuuucacaaaaacucgacuccaaagaccucguccgagucauucuccacauugccaaacaccggggcuauggcaacaaacacgcaaaagacucgaaagacaccgaaucaggcaaggucaagaaagccaucgaauuuaaccggaaaacccucgcagaaaagggcuaccgcucugucggggaauaccucuaccgggaguucuuccaacagagcagaaucagccaaaacaacggagcaaccgaguucaucaauguccgcaacaaggccggaaacuacgaacacugcguagcgcaagacaugcuaaaagaagaacucgagaguauccuuaaugcucaacgccaauucggauucucacuaaagcaagacuucgagagcaaacugcucaccaaaaucuucgaacaacgcccacucaagagcuucgccgacaaagugggaaacugcugcuucauagcaggagagaaacgagcacccaaagacucgcccagugccauugaguucauugcacucucacgcacaaucaauacccucauuaaucuauccaaagaaagcggagaaauauacaaccgugcaauuauuuuacaaauugucgaauccaccuugaagaaaggagaaauaucuuacaaagagcuacgcgaaaucauccgacuagacgaacgccuccgauucaaagaccccagacucgacuacucccgagaaaucaaagaagcggaaaaagucaaguucuuagaguucaagcaacucaagggauucaagaaagcacuaggagagagcuucacaacgcuagccaucucacaguuggacgaaaucgcagaacacaucgcccucaucaaagaccgcguaaaacuaaaugaaaaacuagagucguacgcacuaacaaaagaacaacgcgaagcccugucaaaccucagcuuuuccgcccacauaaacuugagccuacaagcacucaagcaaauccuaccguucaugcgcggagacaauggagagcaaugccucgacuacgacgaaucagucgaaaaagcaggccugaaagcccuuucaaaagacacccugaaagggcagaugcugcccccacucaacgaguucgaacccuaccuuagcaaccccgucguagcccgggcccucgccgaauacagaaaagugcugaacguccuccucaaacaguacggcucgccccacaaaauacacaucgaauacgcacgcgaagcaaaacuauccuccacagaacgccagaaauacgagaaagaacagaaagacaacuacgccgccaaccaagccgcacacaagaaaugccaagagcugggacuagaaccaucuagcacaaaccuccucaaacuaaagcuauggcaagagcaaggaggacucugcuuguacucaggcgcaaagauuaccaucaguuaccuucaagacccgacagcgcuccaagucgaccauauauauccguauucacgaucauucgaugauucauacaugaacaagugccucguccugaccaaggccaaucaagagaaaggcaacaggacucccuucgaggcuuucgguacugauucggcuaaauggggcgucaucacgacccuggcgcaaaaacucccgcacaagaaacgucgacgaauccucaacacugccuucaacgacaaagaagccggauuuaaacuacgcaaccuaaacgacacauccuacauagcccgucuagucgcggacuacacagaaaccuaccucgaauuucuaccacuuguagaaucggagaacaccacacucucuaagggccaaaaaggcucaaagaaacacauagcaaucgucaacggaguauuaacgagcacaaugagguacuaccucggauucgcaucaaaggacagggacaaccaccuccaccacgcccuggacgcagucaucaucggcuucaugaacgacagcguaauuaaggccuuuuccgacuucaagaaaacucaagaaacgucaaaagcggcuuacuacgcgcacacacuaagcaaacaagaauacaagaaacaacgcgccuucauucaacuccccagcggcgagaacuucagagucucaguccucgaaaaagucgagagcgucuuuguguccaaacccccacgcaaacggguccgcggggcacugcacgaggccacauucuacagcccuaacgacccaaagcucuuaaagaacuacggcggaaccaaaggcgucgaacgagcccucgcacugggcaagaugcgaaaagucggggccaaaauaguaagcaauggcgcaauggugagaguagacaucuucagacacaaaagcuccggcaaauucuacggcguccccguauacaccauggacuuugcgcucgggauccuccccaacaaggcugucguaguaggaaaagaccagaacggagucauaaaagacuggcuagagauggacuccuccuacgaguucaucuucucccucuacaaagacgacguaauccucguucagaagaaagaaaugcaacgacccgaacuaugcuacuuugucucauucgacacaaguggcgccucaaucaaaguggccaaacacgacaauaacuuuuccacacuaaccgagaaccaaaaacugcuguucagcaacgccacaaaagaagagguggucggaaaauccauaggcauccagaaccucaaagucuucgaaaaauggcaaguaucaguacuaggcgaggucaaacgaacccaauccuacccccgcgaaaacauaucacuugccuccaaagcuaagaaauga

SEQ ID NO: 7239 - RNA, 3075 nt, Artificial Sequence
  Cas9 variant
augauccgcacccuaggcaucgacauagggauugcaagcaucggaugggcagucaucgagggagaauacaccgacaaaggacucgagaacaaagaaaucguagccagcggcguaagaguauucaccaaagcagaaaacccgaagaacaaagaaagccucgcacuaccacguacuuuggcccgcucagcacgcaggagaaacgcacggaaaaaggggcgaauccaacaaguuaaacauuaccuauccaaagcacucggacuagacuuagaaugcuucguacaaggagaaaaacuagccacacuauuucaaacaucgaaggacuuccuaagccccugggaacuacgagaaagggcccucuaccgggugcuagacaaagaagaacuggcacgcguuauacugcacauagcaaagcgacgcgguuaugacgacaucacuuacggggucgaggacaacgacuccgggaaaaucaagaaggccaucgccgaaaacagcaagcgaaucaaagaggagcagugcaagacaauaggagaaaugauguacaaacucuacuuccaaaaaucgcucaacguccgaaacaagaaagaaucguauaacaggugcguuggaaggucagaguuaagagaggagcugaaaaccauauuucaaauccaacaggaacucaaaagccccugggugaacgaagaacugauauacaaacugcuaggaaaccccgacgcucaaagcaaacaagaacgugagggacucauauucuaccagcgaccgcuuaaagguuucggagacaagaucggcaaauguucgcacaucaaaaagggggagaacucgccauaccgggccugcaaacacgcgcccucagcagaagaguucgucgccuuaaccaaaucaaucaacuucuugaaaaaccugaccaaucgacauggacucugcuucucccaagaagacaugugcgucuaccucggcaaaauccuccaagaagcccagaaaaacgagaaaggccucacauacagcaaacugaaacuacugcuagaucuuccaagcgacuuugaguuccucggccuagacuacucgggcaaaaacccagaaaaagcgguauuccucagccuacccaguaccuucaaacucaacaagaucacccaagacagaaaaacccaagauaaaauagcaaacauccugggcgcaaacaaagacugggaagccauccuaaaggaacuagaaucgcugcaacucagcaaggaacaaauacaaaccauaaaggacgccaagcucaacuucucaaagcacaucaaccuuagccucgaagcauuauaccaucugcuacccuuaaugcgugaagggaaacguuacgacgaaggagucgaaauccuacaggagagaggcauauucucgaaaccccaacccaaaaaccgacaacuccucccgcccuuaucagagcuggcaaaggaagaauccuacuucgacauucccaaccccguccuacgccgugcacugucggaguucagaaaaguaguaaacgcacuccuagaaaaauacggcggauuccacuacuuccacaucgaacuaacccgagacgucugcaaggcaaaaucagcccgaaugcagcuggagaaaauaaacaaaaagaacaaauccgaaaacgacgcagcgucgcagcuacucgaaguacugggacuccccaacaccuacaacaaccggcucaaaugcaaacucuggaaacagcaagaagaauacugccucuacucaggagaaaagauaacaauagaccaccuaaaggaccaacgagcacuacaaauugaucacgcauucccccugucccgaucacuagacgacucccaaagcaacaaaguacucugccucaccuccagcaaccaagaaaaauccaacaagaccccauaugaauggcuaggcagcgacgagaagaaaugggacauguacguaggacguguauacagcagcaauuucucacccucaaagaaacgaaaacuaacccagaaaaacuucaaagaacgaaacgaagaagacuuccuagcccgcaaccucguggacacgggcuacaucggccgagucacgaaagaauacauaaaacacagccucagcuuccucccccucccagacgggaaaaaggaacacauaagaaucauaucaggcagcaugacaagcacaaugcggagcuucuggggaguccaagagaagaaccgggaccaccaccuccaccacgcacaagacgcaauaauaauagccugcauagaaccaucuaugauccagaaauauacaacauaucucaaagacaaggagacacaccgacucaaaucccaccagaaagcacaaauacugcgcgaaggcgaccacaaacuaagccucagauggccaaugucaaacuucaaagacaagauacaagaaucgauccaaaacaucauccccucccaccacguaucacacaaggugaccggagaacuccaccaagaaacaguaaggaccaaagaguucuacuaccaagcguucggaggagaagagggcgugaagaaggcacuaaaguucggaaagaucagggaaauaaaccaaggcaucguagacaacggcgcaaugguacgcguagacauauucaagucaaaagauaaaggaaaauucuacgccguacccauauauacauacgauuucgcgauaggcaaacucccgaacaaagccaucguccaaggcaagaaaaacgggaucaucaaagacuggcuggagauggaugaaaacuacgaguucugcuucucccuauucaaaaacgacugcauuaaaauacaaacgaaagagaugcaagaagcggugcucgccauauacaaauccacaaacucagcaaaagccaccaucgaacuagaacaccuaagcaaguacgcucucaagaacgaggacgaagagaaaauguucacagacacagacaaggaaaagaacaagaccaugacucgggaaagcugcggaauacaaggauuaaaagucuuccagaaagugaaacucagcguccugggagaagucuuggaacacaagccccggaaccggcaaaacaucgcccuaaaaacgacacccaagcauguauga

SEQ ID NO: 7240 - RNA, 3078 nt, Artificial Sequence
  Cas9 variant
augggaggcuacaugccccagcucaugcgcuacaggcucgcacucgauaucggaucaaccagcaucggaugggcuaugauccgccuaagcaugcaaaaugaaccgauugccauaaucagaaugggaguccgcauauucucagacggccguaacccgaaagaugggagcucccuagcagugacacgacgcgucgcaaggcagaugagaagacgccgggaccgccuccuaaagcgcaaaacacgacugcuuaacgcccucgugcagaaaaaguucuuccccgaggacgcagacgccaggaaagcccucgucguacucaaccccuacgagcuaagaaaagaggggcuauacagacaacucagcggccccgaguucggacgagcacuauuccacaucucgcaaagacgcggcuuccuauccaaccgaaaaacagacaagaaagacaacgacuccucaguccuaaagaaagcaaucguagaccugcgucaacagcucgaagucgaaaacugccaaaccaucggugaguggcuguucaagcagcaacaaagcgggaaaagcguucgcgcccgccugcgaggaaaaacacaaaaagacaaagcauacgacuucuacaucgaccgagccaugaucgcacacgaguucgacacccucugggugagccaagccaaguaugacccacuccucuucaacgaggacgcaagagccauauuacgggauauacugcucuaccaacgcccgcucaaacccguaaaacccggaaggugcacacugaucccagaugagucgcgcgccccacucgcccucccccugacgcaacaagcacgcauauaccaagaacuuaaccacuuacgcaucaccacaccagcgcuuggcgcccaggcccuaacagucgcccagcgcaacacaauagcagcgcuucuagagaaaucagacguaacauucgugaagaucgccaaagcgcuuggacuaacaagcacgaccgaguuuaacuuacaagacauaaaacgcgaccgacugaaagggaacgcaaccgcuauaauccucgcacgcaaccaauauuucggccgacgcuggcaugacuucaacgccgaccugcaaaaccucaucgucgacaaacucgucaacgaaggaagcgaaacagcccuuaucgaauggcuaaaagcaaacacagacguagacgaauccgccgcagagcggguaucaggagucacccugccggaaggauacggcucgcuuuccguagcagcacuaaggcgacuccucccagcucuuaaagaagacgucgucguuuacucagaagcaguuaaacgcgccggauucgacagccacagcgcgcuaagccuaauagaacagacaggggagcucuaccaagaacuccccuacuacggggaaguccugcaacgacacgucggcuucggcuccggagaucccaaugauagcccugaaagaagguuuggcaaaaucgcgaaccccacgguccacaucggacuaaacgaacuaagaaaaauaauaaacgcccuaauuaagcgcuacggcaacccagcagaagucgucguagagcucgcccgagaccucaagcucagccgggagaaaagaaaagaaauccaagaagaacaaaaacaacgacaagaccguaacgaaaagcgcauaaaagacgcaugcgaaauucugggcaucgacccccucgugauugacagaggcaaacggagagaaauaagccagaaaaugcaacucugggacgaacuuaacccaaaagacgcagccaaucgucgcugcccauacacaggcgaucaaauaucaaucgaaaaacuccugucggccgaagucgaaaucgaacacauccuaccauuuaguaaaacacuagacgacucccucaacaauaaaacaguggcaaugcgucgcgcaaaccgcgauaagggaaaccgaaccccauacgaagccuucggagaaucccuaaacccagacuaugacuacgacgcaaucuuacaacgggcaucacucaugccacgggaaaaacgaaagagauucgccucagacggguaccaacaauggcucagagacgacaaggacuuccucucgcgagcacuaaaugacacugccuaccuaucaagaauugccaaggaauacuuaacccucauaugcccaccaaacagcguccgggcaauaccggggagaaugacagcccaauuacgcgcaauguucggucugaaccgacuacugucagaaggcggaauuaaaaaccgggaagaccacagacaccacgcaaucgacgcggccgucauaggcgucaccgaccaggggcugcuacaaaaguucagccgagccucagcccgcacgcgugaacuccaacuauccagacucguagacgacaugccccucccaugggacaccuacagggaacacgucacgcgagcccucgaacaccucguagugucccauaaaccagaccacggcuaccaaggcaagaugcacgaggauaccgccugggggcuuagggacaacggacaaguaacacgccgcgugagaagcgaagacggcgguccccgccaacgacuucuugaaaacaaaaacguagucaagaucaacuccacgcgggacuucagccgccacggcauagacgagcaaggccaagucaacgcauacaaaggauaugucgggggaagcaacuauugcauagaaaucuggauagacgaaaaaggaaaguggaauagcgacgucgucuccaccuuucaggcauaccaaaucguacgcgaacugggcgaaaaggcagccuggcaaaaauugcgcaauccccuacuaucacucucugcaaagccacucgucaugcgccuaaucauagacgacgucguaaaaaugcaaauagcagggcaaaacaaaaucaugcgggucgucaaaauagcacaaaacggacaaauauuuuucgcggaacacaacgaggcaaacguagacgcgagagacaaagacaaaaacaaccccuucaaauacauuagcaagacggccgggagccuacaaaaagcgggcggcauacauauggcaauuucacccaucggcgacgcacgccccguccgcuacggucgcuga

SEQ ID NO: 7241 - RNA, 3084 nt, Artificial Sequence
  Cas9 variant
augaaguacacccugggccucgacgugggcacuaauagcaucggcugggccguccuggagcugaacacgaauggggagccccagcgcaucgagaagcugggcucccggaucuucaccgacgggcgccacccgaaggacggcacaacccuagccagcaagcggcgccagaagcggcacgaacgccggaggcgggaucgcuugcaccagcggaaaaagcucgugcugaaccagcugguguccaugggccucuucccccagagugagcaggagcagcaggaccugaaguccuuggacguccucacgcugagagcgaacggugugagcaaacaguuaucugccuacgagcucggccggguguucuacuaucugaaccugaagcgcggguucaaaagcaaccggaagggcgguucugaagaggacaaggccaauaaaaucagcgagcgcaucaagaagcuccaggagcagcugaaggagaacgacuucaaaaccgucggccaguaccugcacgaccgguacaucaagggccucuccacaaaggccacaauagagaacgacuuccaucuccugcgccaacugaucgaggacgaguucgacuucaucguggagacgcagagcaaguuuuuccccgagaucuccgacgagcaguggaacacccugcgcaaccgcauguuccaccaacggccccugaagccgguggaaaccgggacauguagccucuucgaggacaagaagcgcacauacaaguacaugcccuccuucgaggaguaccgcuucuuaaccgagcuguuuaacuuaaguuaucaggaugagaacuuccacucccacagcuuguccagcgagcagaucuucaaagucuuucacgagcugaagaacacccgggaggccaccuacacgaagauuaagaagcuccugaagcugcccagcgacuugaguuucagcaucgagcgcucaaagagcaaggacaaaauaaagaucuccaccaccaaccauuucuucagcaagucccugcuguucgcggaggagugggccagccucgaccugaagcugaaggacgaaguggccgagauauacuucucugacaugagcguggaggagaucaagaagggccuccugcagcugaagaucgauuccgagaucaucgaaaaucuccuggaggaaaaggucccaaauguucaggaggcgaccugcagcuacaguaaggaggcccugcaaaagaucgugagccucauccuggaggaagagaggcacccgacacugaucgucgacgaccuguucaaaaacgagaaggaggaaaccucccucaucgaccgccucgacuacuacggggccagcauccccgacuccaugcagcccaucccccagcacaucaaggacaacaaucugacccucaacgaggaugagaagcgguauggcaagaucgccaacccgaccguccacgccgcccugaaccagauccgccagguggucaacgaccugaucgagcaguacgggaagcccacgaacauacacaucgaguucgcgcgagaccucaagaaguccaaggaggaacgcgacuucgacaaccggaagaagaagaagaaugaggagcugaacgagcagguccgcgacuucauagagaagcacaaucagaagccaagcgccuucaacuucgagcggguaaagcugugguucgaacucgacgccaugaacaaccaggugugugccuacagcggaaagaccaucagcgcccgcauggugcuguccgacgaggugcaagucgaccacauccugcccuucagcagaacccucgacgacucacuggccaacaaggugcugguccucgccagcgagaacgugaagaagcguaaccggaccccguacgaggccuucggccaggacacggagaagugggccuccauucaggaguuagccaagcgccugcccuaccacaagcaguggcgguucgcggaggaugccaucaagaaguucgaagagaaggaccaguucuugcagcgccaccugaacgacacccgguacaucagcaagaucgccaagaaguaccugggguccaucaccgaucccuacaagaucguggccagccgcggccagaugaccuccaucauccgcgggaagcucggccugaaccaguucauccagaagcccgacgggacgaagaaccgagaggaccaccgccaccacgccaucgacgcgcugaccguggcccucaccagccggaguuacuugaagcgcauaagcgacgccuccgcccggaaccaggacccgaaccgcauccccauacccgagcccuggaagggguucaucaaagacgcggacgugaaguucaacgagaucauaguuagccacaagguugaccacggcaagaacgggccguucauggaggaaaccugcuucggccuuaucaaaaaucccaacaaguacgaggaggagaacgacuucaagcugaucacgaccaagucacuggacagcgucaaggaccccuccaccauccggagccagucacugcaaaaccucgccgaaaagagcggggucaucagccuggccaaguccggcgucaagaagcugcgcguguacgacgugaccaaggagaacccugccgacauuggacucaucgagagcgggcuggcuaagaucacgcacggcaaggacaagcagcaugugaaacacuaccaaaagggggacauaaauuaccuggcgaucuggugccucccgcaaaacaucacacugaaguccgacaaccacaagaagcggaagaccgacuacauauucaccgcgauuaagaccuucgaccugaacagcaagaaccccaacgaccuccguccacacccggcagccaagcuggugacaaagguguacaagggcgacaccguugcccuggagguaaacaaccagcucaacuacuacauagugaaguccauccgggcggccaacaagaagcuguacuuccugaaaaucaaccagagcucugagcucgccaacgagacccaguuuauacccgcauacaccaaacuggucgacuacaaguuccgcaaggugagcgugucccccacgggggucaucaccgacaacggcccccugcucaaguga

SEQ ID NO: 7242 - RNA, 3090 nt, Artificial Sequence
  Cas9 variant
augagaucccuccgauacagacucgcacuagacuuaggaaguacuucccuaggaugggcccuguuccgacucgacgcaugcaacagacccacggcagucauuaaggccggugucagaauauucucggacggaagaaacccaaaggacggaucuagccucgccguaacgagacgagcggccagagcaaugcggcgccgacgagaccgauuauuaaaaaggaaaacacgcaugcaagcaaagcuaguugagcacggguucuuuccggccgacgcaggaaaacgcaaagcacuggaacagcugaacccauacgccuuacgggcaaaaggcuuacaggaagccuuacugccgggcgaguucgcccgagcacuguuccacaucaaccaaaggcgcggguucaagagcaaccgcaaaacagauaagaaggacaacgacucagggguccuaaagaaagccauaggacagcugagacaacagauggccgaacaaggaaguaggaccguaggagaauaccuauggacgaggcuccaacagggccaaggaguccgagcacgcuaccgcgaaaaaccguacaccacagaagaaggcaagaaacgaauagacaaaagcuacgacuuguacauagacagggccaugaucgaacaggaguucgacgcacucugggcagcccaggccgccuucaacccgacgcuauuucacgaagccgcccgagcagaccucaaagacacccuacuccaccagcggccauuacgaccgguaaaacccggaagauguacccuacuaccggaagaagaacgagcaccacucgcacugcccucaacacaacgauuucgaauacaccaggaagucaaccaucugagacugcuagaugagaaccucagagagguggcacuaacacuggcccagagagacgcgguggucacagcccuagaaacaaaagcaaaacucuccuucgagcaaaucagaaaauugcuaaagcuaucagggucggugcaauucaacuuagaggacgcaaaacgcacggaacucaaaggcaacgcaacauccgcggcccucgcgagaaaggagcuauucggcgcggccuggagcggcuucgacgaagcccuccaggacgaaauuguauggcagcuaguuaccgaagaaggugaaggagcacuaaucgcauggcuacaaacccacacggggguagacgaggcaagggcccaagcaauaguagacguaagccuacccgaaggguaugguaaccucagccgaaaggcacuggcgcgaauagugccagcccugcgagcagccguaaucacauacgacaaagcaguccaagcagcaggauucgaccaucacagccaacugggauucgaauacgacgccagcgaaguagaagaccucguacacccggagacaggagaaauccguuccguguuuaaacaacuccccuacuacggaaaagcucuacaacgccacguggccuucggauccggcaagcccgaggacccagacgagaaaagguacggaaaaaucgccaaccccacugugcacauagggcugaaccaagugagaauggucguaaaugcucugauaagaagguacggacggccaacagaagucgucaucgaacucgccagagaccugaaacaaagcagagaacaaaagguugaagcacagcgacgacaagccgacaaucaaaggagaaacgccaggauacggcgaagcaucgcggaaguccuggggauaggcgaagaaaggguacgaggcagugacauacaaaaauggauaugcugggaggaguugucauucgaugccgcggacagaagaugccccuacagcgggguacaaauaagcgcagcaauguuacuaagcgacgaaguagagguggaacacauccugccauucagcaaaacccuagacgacagccugaacaaccgcacaguugcgaugaggcaggccaaucgaaucaagcgaaacagaacgccaugggacgcccgcgcggaguucgaagcacaaggauggucauacgaggacauccuacaacgagcagaaaggaugccccugagaaagagauaccgauucgcaccggauggauacgaacgguggcucggagacgacaaggacuuccuagccagagcgcugaaugacacaagauaccuaucacgaguggccgcggaauacuuaaggcuaguaugcccagggacacggguaaucccaggccaacucacagcccugcuccggggcaaauucggacucaacgacguacuaggacuagacggagagaagaacagaaacgaccacagacaccacgcgguagacgcaugcgugauaggcgugacagaccaagggcucaugcaaagguucgccaccgcaagcgcacaagcccgaggggacggucuaacccgacuuguggauggcaugccaaugccguggccaaccuaucgagaccacguagagcgggcgguacgucacauaugggucagccaccgcccagaccacggauucgagggcgcaaugauggaggaaacaucauacggaauacggaaggacggaagcaucaagcaacgaagaaaagcagacggcagcgcaggcagagaaauaagcaaccuaauacgcauccaugaagcaacgcagccccuacgacauggagucucagccgacggccagccacucgccuacaaaggcuacguaggagggaguaacuauugcaucgaaaucacagucaaugacaaaggcaagugggagggagagguaaucagcacguucagagcauacggcguuguaagggcaggaggaaugggacggcuaaggaacccacacgagggacagaacgggcggaaacucaucaugcgacucgucauaggggacucagucagacuugaaguggacggagccgaaagaacgaugagaauaguaaagauaagcggcagcaacgggcaaaucuucauggcaccaauacaugaggcgaacgucgacgcacgcaauacggacaaacaagacgcauucacguauacgucaaaauacgccgguagccuacaaaaagccaaaacgcgacgcgucacuauaagccccaucggagagguaagggacccgggcuucaaaggauga

SEQ ID NO: 7243 - RNA, 3090 nt, Artificial Sequence
  Cas9 variant
augaaauaccgccuagcacucgaccuaggauccacaucacucggcugggcgauaguacagcuaaacgcaaaagacgaaccaugcgccauaguaagagccgggguaagaauauuccccgacggacgaaacccuaaggacgguucaagucuagccgucacccgacgaaacgcacgcgcgaugcgacgacgcagagacagacugcugaaacgaaaggcacguaugcaacgacuccuaauagaacacgaccuauucccagcagacgaagccgcgcgaaaagcacuggagacacucaacccauaugaacucagagcgaaaggacuggacgcagcccuuacuccggcagaguucgcgcgagcccucuuccaccuaaaccaacgccgaggcuuuaaaagcaacaggaggaccgaccgcaaagacaaugacucaggagcccucaaggccgcaaucggagggcugcgagcacaacuagacaccgcaggggcggacgggagagcaagaaccgucggagaacuacucuggcgacguauguccgacccaaacguccuaacaguaagagcacgcuacagagaacaacggaucacaaaagaugacgguaaaacacgcguugauaaaagcuaugaccuauauguggaccgagcaaugguagaagcggaauuugacgcacugugggccaagcaggccgagcuaagcccaacgcaguucggcgaggcagcgcgcgcaacacuaaaggacugccuacuacaccaaagaaaccucaggccaguacggccaggccggugcacccucgaaccagacgaacccagggcgccccucgcccuuccaucccaacagcgcuucagaauccugcaagaagugaaccacuugagacuauuaggaggcaggcugcuugaagagucauuaagcgucgaacaaagagacaaguuagucgcugcccuagaagacggcagcaagagcuucaaaacggcaauaccaaaacugcugggacuaccaggaacgguucaauucaaccucgcugacgcaaaaagaaccgaacucaaaggaaacgcaacgucaaugcuccucggaaagaaagacuucuucggaccagccuggcacggauuuucagaggcacgacaagacgaaauaguaaugaggauacaagaggaagaaucagaagccaggcuagucgacuggcucgcaacaagcaccggcguagacgaggcacacgcacuaaaaaucgcgaacgcagcccuucccgagggauacggcucacugagugccaaagcacuagcaaagauacuccccgccaugcgcgcagaaguaauaacauacgacaaagcuguacuagccgcaggcuacgaccaccacucucacauaagccacgcagccuccacaggggagauacuccccgaguuacccuacuacggcgaauaccuccagagacacgugggauucggcaccggcgaacuaaacgacacacccgagaagagauucggccgcauagcaaaccccacagugcacaucggacuaaaccagguaagagugguugugaacgcacugauaaaaagauacggccaccccaccgaggugaucgucgaaguggccagggaccucaaacagagccaggaucaacggcgcgaaacacaagaacagcaggcaaagaaucagaaaaggaacgagcgauuaagaaaagacgccgcagcaauacucggcauugcagacgagagagugcgacuagcggacauacaaaaacuuauacugugggaagaacugaguuucgacauagccgaucgacggugccccuacagcggcguacagcucagcgccgcgauggugcuaagcgaacaggucgaaauagagcacauacugcccuucagcaugacacuggaugacagccuaaacaacaaaaccguagcaaugcgacugguaaaccgacucaaaggaaaccggaccccuugggacgcgcgagaggcauucgcggggcaaggaugggacuaugacgggauucucaugcgagccgagagaaugccgagggcaaagcgacaaagguucgcgccagacgggcucgaaaaguggcugaaagaagacaaggacuuccuagcgagagcacuaaacgacacacgacaccucucacgcguggcgagagaauaccucagucuaguaugccccgcaagcacccgaguaaucccaggccaaaugacagcgaugcugcgcgcgaaauucggacucaacgacauccuaggauugaacggagagaaaaacaggaacgaccaccgccaccacgccgucgacgcaugcguggucgcagucacagaccagggacuccuucaacgguucgcacaagcuagugcagacgcacggggaaaaggacuggacagacucgucgaaacaaugccagacccaugggacagcuaccgcgagcacguacaaagagcaguaaauaguaucuggguaagccacaagccggaccacggauuugagggagcuaugcacgaagacaccacguacagaccgccccaccucgaccccaagaacauguggagaacacgcgggauuggagggggcaagccaaacgagaaggaagcagacucaaaagccauggucggguucacagggccagagcaucugcagagacaccaccgcgacaaggccggacaacaacuaccguacaaaggauacgucgcaagccccaaauuuugcauggacaucgugagaaaugacaagggcagaugggaaggagaagucgucagcaccuucgaagcauacaggcucgucagugaguucgggagagacgccgcccucgcacacauccaaagcaaaagccgaagcauuucgggcaagccacucguaaugagacuucaaggaggggacauggugagauuugacgacgacgaaggcaggcccguaguccugcgcgugguaaacaugacaggaaacggucagaucuucuucgcgccacacaaugaagccaacggcgacgcaaggaacagagacaaacaagaccaauucgucuaccucagcaaauacgcagggucccuacagaaagcaagagggaggagaguaacaguaagcccagcaggagaguuaagagaccccggguuuaaagaauga

SEQ ID NO: 7244 - RNA, 3090 nt, Artificial Sequence
  Cas9 variant
augagaucacuacgauacagacuggcacucgaccuagggagcacgagucucggaugggcacuguucagacuagacgccugcaacagacccacggcggugauaaaggcaggcguacggauauucagcgacggccggaacccgaaagacggcucuagccuagcagugacccggcgcgcggcacgagcgaugcgacgacgaagagaccgacuccugaaacgaaaaacccgaaugcaggccaagcuaguggagcacggauucuuccccgcggaugcaggcaaaagaaaagcacucgaacagcuaaaccccuacgcgcuacgagcaaaaggacuccaagaagcacuccugccgggugaguucgcaagagcacuauuccacauaaaccagcgccgcggauuuaaaaguaacagaaagacagauaagaaggacaacgacagcggcgcacuaaagaaagcaaucggccaacuacgacagcaaauggccgaacaaggaagcaggacaguaggagaauaccuguggacaagacugcagcaaggccagggcguaagagcaagauaccgcgaaaaaccauacacgaccgaagaagggaagaaacgcauagauaaaagcuacgaccucuacauagacagagccaugaucgaacaggaguucgacgcccugugggcagcacaagcagccuucaacccgacccuauuccacgaagccgcucgcgcagaccuaaaagacacccuccuccaccaaaggccccuccgcccuguaaaacccggacgaugcacgcuccucccagaagaagaacgggcuccacuagcgcuacccucaacccaacgauuccgaauccaccaagaaguaaaccaccuacgccuccuagacgaaaaccuucgcgaagucgccuuaacucuggcccagcgagacgcaguggucacagcccuagaaacgaaagcaaaacuguccuucgaacagauacgaaaacuccuaaaacuauccggcagcguacaauucaaucuggaggacgcaaaaagaacggaacuaaaggguaacgcgacgagugcagcccuggccagaaaggaacuauucggagcagcauggaguggauucgacgaagcgcugcaggacgaaauaguguggcagcuagucaccgaagaaggagaaggugcauugauugccuggcuacaaacacacaccggaguggacgaggcacgagcacaagcaaucguagaugucagccuaccagagggauacggcaacuuaucaagaaaagcccuagcccggaucguaccagcccucagagccgcaguaaucacuuacgacaaagccguccaggccgccggauucgaccaccacucacaacuaggguucgaauacgacgcaagcgaggucgaagaccuagugcacccggaaaccggagagauacgaagcgucuuuaaacaacuaccguacuacggaaaggcacugcaacgccacguagccuucggauccggaaagcccgaagacccagacgagaaaagguacggaaaaauagccaauccaaccguacacauuggacucaaccaggucaggauggucguaaacgcgcuaauucgccgauacggaagaccgacagaaguagugaucgaacucgcacgggaccuaaaacaaagccgcgaacagaaggucgaggcacaacggcggcaagcggacaaccaacggagaaaugcaagaauccgcagaagcaucgcagagguacuuggaaucggugaggaaagaguacgaggaucugacauacagaaguggaucugcugggaggagcugagcuucgacgccgccgaccgccgcugcccguauagcggaguccaaauaagcgcagcaaugcuccucagcgacgaaguagaaguagaacacauacugcccuucuccaaaacccuagacgacagucuuaacaaccgaaccguagcgaugcggcaagcaaaucgcauaaagcgcaauagaacacccugggaugcaagagcagaguucgaagcacagggauggucauacgaagacauacuccaaagagcggaaagaaugccacuuaggaaacgauacagauucgccccagacggcuacgaaagauggcucggcgacgacaaagacuuccucgcccgagcccuaaacgacacaagauaccuuucgcgcguggcggcagaauaccuacggcuagugugcccagguacgagaguaaucccuggccaacugacagcacuccuccgaggaaaauucggacucaacgacguccucgguuuggacggggagaaaaacagaaacgaccaccgccaccacgccguggacgccugugucauaggaguaaccgaccagggacucaugcaaagauucgcgaccgcuagcgcccaagcacgaggagauggacuaacaagguuaguagacggcaugcccaugccauggccaacauaccgagaccacgucgaaagagcaguaagacauauauggguaagccacagacccgaccauggcuucgaaggagcaaugauggaagaaacaagcuacggcauuagaaaagacggaagcauaaaacagcgccgaaaagcagauggcagcgcaggcagagaaauaagcaaccugauccgaauacaugaagcaacccaaccccuaagacauggcgucucagccgacggacaaccccucgccuacaaaggauacguuggagggagcaacuacugcaucgagauaacagucaacgacaaaggcaaaugggaaggggaagugauuucaacauuccgggccuauggcaucguacgagccggagggauggggcgccuccgaaacccacacgaaggccaaaauggccgaaaacuaauaaugaggcugguaauaggagacagcgugaggcuggagguggauggcgccgaacgaacaaugcgaauagucaaaauaucgggcagcaauggccagauauuuauggcgcccauccacgaggcaaauguggaugcccgcaacaccgacaaacaagacgcuuucacauacacaagcaaguacgcgggcagccuacagaaagccaagacgcgcagaguaaccauuuccccaauaggagaggugcgggacccaggcuucaagggcuga

SEQ ID NO: 7245 - RNA, 3096 nt, Artificial Sequence
  Cas9 variant
augccagcuauauaucgccucgcacuagaccucggcagcacaagccucgggugggcaguauugagauuagagccagcagcgcucgagcccaucgcuauaaucaaagccgguguccgaaucuucagugacggacgcaacccgaaggauggagccagucuagcaguaacacgacgcgcagcgcgagcaaugcgacggaggcgagaccggcuauuaaaaaggaaagcgagaaugcaagacaagcuagugaaacacggguucuucccuucagauauggacgagcgcaaagcccuggagaggcuggacccauacgcccugcgggcgaaaggccugcgagaagcacucaccccgggggaguucgcccgagcccuauuccacaucaaccaaaggcgaggauucaaaagcaaccgaaaaacggacaaaaaggacaacgacucaggcgcgcuaaagaaagcgaucagccaucugcgacaacagauggaagccgggggacacaggacagucggcgaucaccuauggagccgccugcaacaggggcugggcguuagagcgcgcuaccgagagacuccauucacaaacgacgaaggaaagaaaagaauagacaaaaguuacgaccuauacauagauagggcgaugaucgaacaggaauuugacgcccugugggcagcacaggccgcauucaacccagcgcuauuccacgaaguagcgagagccgaccugaaagacacacuguuacaccaacggcgccuacggccaguaaaacccgggagaugcacccuacuuccggaagaggaaagggcaccccucgcccugccgagcacacaaagguuccgaauauaucaggaaguaaaccaccuacgccugcuaggggaagaccuuagagaaguagcccucacacuggcgcaaagagacgcaguagcaaacgcauuagaaagcaaagcacgucuaacauuugagcagaucaggaaacugcuaaaauuaucuggaucgguccaauuuaaccuggaagacgcaaaaagaacagaacucaaaggcaacgcgacgagcgcggcacuggccagaaaagaacucuucggagcggccuggggcggguucggagaagcccuacaggacgaaauugucuggcagcuaguaacagaagagggcgagggagcucuaauugccuggcugcaagcgcauacaggcguagacgaagccagagcgcaagccauagcagacgcgucacuaccagaaggauacggaagccucagcagaaaagcgcucgcaagaauagugccagcccugagagcaggcguagucacguacgacaaagcagugcaagcagcaggauucgaccaccacucgcaacugggauucgaguaugacgcgggagaagucgaagacugggugcaccccgacacaggagaaauacggccggucuuuaaacaacuaccauauuacggaaagccccuacaacgacaugucgcauucggaagcgggaaacccgaagauccggacgaaagaagauacgguaagaucgcaaacccaacaguacacauaggacuaaaccaaguacgaaccgucguaaacgcauuaauaaggcgguacggaagaccaacagagguaguaauagaacuggcacgcgaccucaaacaaagccgggaacaaaagguggaggcccaacguaagcaagcagaaaaccaaaggagaaacgcgcgaauccgaaaaucaauagcggagguacuagggauaggagaagaacaaguccgaggagcagacauucaaaaauggaucugcugggaggaauuaucauucgacguagcagaacggaggugccccuacagcggaguacaaauaagcgcgcgcaugcuacucagcgacgaaguagagguagaacacauacuaccauucagcaaaacacuagacgacagccuaaacaacaggacagucgcaaugagacaagcgaacaggaucaaacggaaccgaacgccuuggaccgcacgugacgacuucgaggcacagggauggucguacgagggcauacuccagcgagccgaacgaaugccgcuaagaaagcgauauagguucgccccagacggauacgaacguuggcugggagacgacaaagacuuccucgcccgcgcacuuaaugacacuagguaucucucucgcguggccgcagaauaccuacgccuagucugcccggguucaggcacccgagugauaccaggccagaugacugcaagacuuagaggaaaauucgggcuaaauggaguccugggcccagauggggaaaagaacaggaaugaccaucggcaccacgcggucgacgcaugcguaauaggagucacagaccaaggacuaaugcaacgauucgcaaaugcgagugcgcaagcucgggaagacggacuaaccagacugguggacgacaugccccgaccauggcccacguacagagcccacguagaaagggcaguacgccacauaugggugucgcaccgaccagaucacggauuugagggagccaugauggaggaaacgagcuacggcaucggaaaggauggguccauaaaacaacguagaaaagccgaugggagcccuggcagagaaauaacaaaccuuauacgcauccacgaagcaacgcaaccacagaggcacggagcggggcccgacggacaaccauuaccguacaaaggguacguaggaggaagcaacuacugcauagagaucacaaggaacgacaaggggaaaugggagggagaggucauaagcacguuccgagcauauggaauaguccgaacgagcggcuuaggucaauuacggcauccacgagugggacagaacggaagagagcucgucaugcgacugguaaucggggacucaguaagacucgagauagacggaauagaacgaaccaugcgcauaguaaaaauaagcggcagcaacggacaaaucuucauggcaccaauucacgaggcaaauguagacgcacgcaauagcgacaaacaggacgcauucgcauauacauccaaguacgcgggcucauuacagaaaacaaaagcacgcuucgugacaauauccccgaucggcgaaguacgagaccuuggcuucaaaggguga

SEQ ID NO: 7246 - RNA, 3099 nt, Artificial Sequence
  Cas9 variant
augaagaagcgcauccuaggccucgacaucgggaucgccagcgugggcugggcccugguggaguucgacgacgaauuucaggacaacaaaaagaaggggaccaucaucaaguccggagugcggaucuucacccgcgcggaaacccccaaggagcgggagagccuggccaagccacgccgggaggcccgcucccaacggcgccggauccgccggcggguggagcggcucaacagcauccgugagcuguucgucaagaacggggugguggaggagugguccgucagcaagaagaaccccaacaacaucuauaucacccugaaccagaucaagacccccuggcagcuccggauggagagccuggaucgcaagcugaccaacgagcaguucgccgugguucucacgcaccuggccaagcaccggggcuacaagagccugcgcaaggacgacaaagcgggaaagguacuugaggccaucucucagaacaagaagcggcugaacgacagcgacuacaggacccugggggagauguucugcaaaaacgaguccuacaaggagcacaagcgcaacaagggcggggaauacauuaacagcguggcccgcgaguugaucgaggaggagguggagaagaucuucgucaagcagcgcgagaagggcaacaacuucgcggacgugaauaccgagcgggaguaccugaagaucgcguucucccagaagcccgccgggagcaucuccaagauggugggcuucugcaccuucgagaacggugagaagcgcgccccgcgggacagcuacuccgccgaguuauuuaagguccucugcacgaucaacaauaccaccuucaccgacaugaagacgggcgagauccgcagcuuuuccaaggaggagaucgggaagacccuggagaccgugaagaacgugaaggacgucaaguacgccaagauccggaaggaucugggucucgaggacagcgugaaguucagcggcguggacuaccgcgagaacgcgaaguccaagggagagggggagauuuucgucagcaugaagaccuaccacgagauuaagucuaagaucgagaaacugagcaaggaaaaaugggacaacuuaaagggcaacacggagcuccuggacuccaucgugaacauuaucgccaaccugaaggacgacgagagcaucaagaaagaguuccaaaagcucaagaucgacgaggacaucaucgaugugcugcugaacuucgaguucaaaaaguucaucaaccucucuuucaaggcccugcggaagaucauucccuuccaauuccaagggcagaaguacaucacggccagcaccuccgccggcuacagcuuaaagcaggaggggaucaagaacaagcucgucccgcccgcuaaggaaaacaucaacguggccgucguggcccgcgccuucgcccagacccgaaaggugaucaaugcggucauccgcaaguacggccaguucgaccagaucaacaucgaguuagccacggagcugaagaacuccaaguucgaccggagcaagaucgaggagggccagaagaaguuccagucccagaaggacaagaucuucaaggaggugcaggagcuccgcgggggcaugacccccagcuccagccuacugcucaaguaccggcuguggcgcgagcaggaugagcggugcguguacuccgggcgcaagaucagcuuugaggaccugcucgacaccggcuuucuggacaucgaccacaucauccccuacuccaaaagcauggacgacagcuucaacaacaagguccugugccucgccgaggagaaccggaacaagaagaacgauauccccuucaacuacuaccagcgcaucgaccgggauuggaaccugcugaucuccaucaucaccagcaugaagaacaugaagaucgcgaagaaguccagacuccugaagcaggagcugagcgacauugaaggauucaucgagaggaacaucaacgacacacgguacgccacccgcuacaucaaggacuuccuggagaauaaccucgaguucaaggagaacgaguucauaaaggugaaggugcaggcgcgguccggcggacugaccagcguccucuccuacaacugggggaugagcaaggaucgcgaggagagcuacuuccaccacgccaaggaugccauuaucguggccugcagcacgcagggcauggugcaguacaucuccaagaucagccagcaguacgagaacgacaaggacaagaugaagaagaucaaggacaagacggagaacugcauccccaagccaugggacuccuucagggccgacgucgaggagagcauugaggggaucuucguguccuucgcgccccgccacaaagugacagggagcgcccacaaggagaccaucuacuccaagaagcaccucgagaaggagcgguacgucacgguuaaaaagucccuggacaagaucaagcugucugaccucgagaacauccccugcaacgagaacugcgggaucauccgcguguuaaaggagcggcuggagaaguucaagaacgacucacucaaggccuucgccgaccccguccacaugccgacgaagugccccaacaagaagggucccgugaucagaagcgugaagaucaaggaguccaacaagaccggcauugagguccggaaagggcuggccgagcgcggcgagauggugcggguggacgucuucauuaaggacaagaaguacuaccuggugcccaucuacgugagcgacuucaagaacaaggaccucccgaacaaggccaucgccgcccugaagcuggagaacgaguggauuaugaucgacaagaccuacuccuucaaguucagccucuucaaggacgacuuaaucaagauaaagaagaaaaaggaggagaucuucggguacuucggcggcguccaccgcucgaccgggacgaucaagaucaagagccgacacaagcccaaggagaucgacgaaggcaucgguucucgcugccugcuagauuuccggaaguuucagguggacgugcugggcaacuacaccgaggucaagcacgagaagcgcaugcccgcuuacaucacccggaaggacaagaaacacuga

SEQ ID NO: 7247 - RNA, 3105 nt, Artificial Sequence
  Cas9 variant
augaaaauucuaggcuucgacaucggcauagccuccaucggcugggcuuucgucgaaaacggcgagcuacgggacugcggcguccgcaucuucaccaaagcggaaaacccgaaaacgggugacucacuggcaaugcccagaagagaggcacggucagucagaagacggcuagcccgccguaaaggacggcuagagacgcucaagcgccuccucgccaaagagugggaccuauguuacgaagacuacaucgccgcagacggcgaacuccccaaagcauucaugggaaagaaccugaccaaccccuauguacugcgcuacgaagcccugcagcgcuuacucgguaaggaggaacucgccagaguuauacuccacaucgcaaagcaccgcggcuacggaaacaagaacgcaaagaucaccaagagugaagagucgaagagggagcaaggcaagauccucucagcccuagcuacaaacgccagugucauagcccgcuaccgaaccguuggagaguacuucuacaaggaguucugugaagucaucaagaacccccaaggacucaacacaaacgaaaacugcacccagccgaaaguccgggugcuaaaacccauccgaaauaaaggcggcgaauacaccaauugcauacuccaggaagaccuucaacgagaacuaagaugcaucuucgaacaucaaaaaggcuucggguuccccauaacacaagaguuccaagacaaaauacucaaaaucgccuucuaccaacgcucccuaaaggacuucucccaccucguaggcaaaugcacauucuaccccgacgaaccgcgugcgccaaaauucagucuaucagcgauagaguucaucaccaaagcaaaaacgaucaaccuccuagucggcauaguaaaagaaagcggcgaagucugggauaaagaacaguggcgcgaaagacuagacucagucuuuagcgcagugugcgaaagagguaaccucacguucgcucagaugcgcaaaauacugaagaucgacgaacgcauacaauucaaagaggucgacuauaccgcaaagaacccagaaaauaagaaauucgucgaguucaaaaaccuaaagaaauuuugcgaaauacuuggugcaaucgucggcgaccgcgcgcucgcugacuccauagcacgggauaugacacuaauaaaagacgaagaagaacuggcacaaaaacuccgaggcuacgggaaauucucucaagaacagaucacccaacucggggcccugaauuucucccaccacaucaauuuaucacuaaaagcgcucagugaaauacuccccuucaugcgagaggggaugcgauacgacgaagccugccaagaagcaaaacuacaagccaaacacaacgacaagaaaagcaaauuccuuccacccuucugcgguucaaucuacgccgaugaacuaacuaacccggugguacaccgcgcaauagccgaguacagaaaaauccucaacgcauuaaucgcaaaauacggcaacguccacaaaauacacaucgaacucaccagagacguaggcaaaaacuuccaggaacgagagaaauacaagaaagaaaucgaaagcaacuacaaagcuagaguacaagccaugcaagaaugcgaaaaacucggauugacgcuuuccgaaggaaacauccuaaaacuccgccuauucauggaacaaaacgaacgcugcgucuacagcggccgaaagaucacacuagcgaaccuaaaagaacaaggcgcacuggaaaucgaucacauacuccccuacucucgauccuccgacgacucauacaugaacaagguacucgucuucacuaacgagaaccagaacaaaggaaacaaaacacccuacgaggcauucggcggagacucccagaaauggggcgaaaucgaaagccuagcccuccgcuccggcuaccccaagaaaaaggcaaaacgcauucuagacaaaggauucggcgaucgcgaagccggauucaaaucacgcaacaucgucgacagcggcuacaucgcccgacuaaucgcaaacuacaccaaagaauacuugaaguuccucccguuagacucacacgaaaacaccgcgcuaaucgcuggagaaaaagacucaaaaauccacguagaagccguaaaaggcaugcucacagcaacaaugcgccacuucuggggccuaggaucuaaaaaccgcuaugaacacacccaccacgccauagacgccaucauaaucgcguauaucaacgccgccaugauacaacgcuuuucacaauuccggcagaaccaagagucauuaaaagcccgcuucuacgccaaagaacuagcaaaagaagaguucaaaacccaacgcgcguucuucgaaccguuuagcggcuuccgagaacaaguccucgccaaaguaggccagaucuucguauccagaccgccccgcaagagggcccgaggcgcgcuccacgaagaaacauucuacucaaucgacgacaagaaacucuccgaaacguauggcggcaaagaagggguacaacgagcgcuaucucuaggaaaaauccgccaaauaggcacuaaaaucgucgccaacggccccaugguccgagucgacaucuucaaacacaagaaaucaggacguuucuacgcaguucccaucuacacaauggacuucgcacuaggcauccuccccaacaaagccgucgucagcggcaaagacaacgaccgcaucaucaaagacuggcuggaaauggacuccaacuacgaguucuguuucagccucuucaaagacgaugucaucgaaguccagaaaaaggauauggaaaaacccgaacuggcauacuucgucagccucaacacaagcucagcuuccauagcucucguuaagcacgacaacaaguucgaaacucuaacaucaaaccaagccaaacuguucagcaacgcuaaagaaaacaacguuaucgccgagucccucggcauccagaaucucaaagucuuuaaaaaguacaaagucagcccucucggcgaaaucaaagaagcgaaauacgaaccccgccagccuauagcccugaaaaccagucccaagaaacaccgcaaacaaaacaacgcccaauga

SEQ ID NO: 7248 - RNA, 3108 nt, Artificial Sequence
  Cas9 variant
augcgacgccuuggccuggaucucggaaccaacagcauaggauggugucuccuggaccucggagacgacggggaacccguaagcaucuucagaacaggagcccgaaucuucucagacgggcgcgaccccaaaucacugggcagccuaaaagcaacccgacgagaggcacgacuaacaagacgacggcgagaccgcuucauccaaagacagaaaaaucugaucaacgcacucguaaaauacggacucaugcccgcagacgaaauccaaagacaggcccuagccuacaaagaccccuacccaauacguaaaaaggcccuagacgaagcaauagaccccuaugaaaugggcagagcaaucuuucacauaaaccagagacggggguucaaaagcaaccgaaagagcgcugacaacgaagcgggaguagucaaacaaagcaucgcagacuuagaaaugaaacugggagaagccggcgcacgaacaauaggagaguuccuagccgacagacaagcaacaaaugauacgguaagagcacgccgacuaagcggaaccaacgcauuguacgaguucuauccagaccgauacaugcuagaacaggaguucgauacacuaugggcaaagcaggcggcauucaaccccucacuauacaucgaagcagcgcgagaacggcucaaagaaaucguauucuuccaacgaaagcugaagccacaagaaguaggaagaugcaucuuccucagcgacgaagaccgcaucagcaaggcacuccccucauuucaacgauuucggaucuaccaagaacucucaaaccucgccuggauugaccacgacggaguagcacauagaaucaccgcaagccucgcgcuacgggaccaccuguucgacgagcuagagcacaaaaagaagcugacauucaaagccaugcgagccauccucagaaagcaagguguaguugacuauccggucggcuucaaccuagaaagugauaacagagaccaccugaucggcaaccuaacauccugcauaaugagagacgcgaagaaaaugauaggaagcgcaugggacagauuggaugaagaggagcaagacucguuuauccuaaugcugcaggacgaccaaaaaggcgacgacgaaguccgcagcauccuaacccaacaguacggccuaagcgacgacgucgcagaagacugcuuagaugugaggcucccagacggacauggcucacuauccaagaaagccaucgaccgaauccuaccaguccuaagagaccaaggccucauauacuacgacgcggugaaagaagcuggccuaggcgaggcaaaccuauacgacccuuacgccgcucucuccgacaaacucgacuacuacggcaaagcccuggccggacaugucaugggcgccagcggcaaauucgaggacagugacgaaaagcgauacggaacgaucagcaaccccacaguacacauagcgcucaaccaaguacgugccguagugaacgaacucaucagacuacacgggaaacccgaugaaguaguaauagagaucggacgcgaccuccccaugggcgcagacggcaaaagggaacuagaacgguuccaaaaagaagguagagcaaagaacgaaagagcccgcgaugaacucaaaaagcuaggacacauagacucgcgugaauccagacagaaguuccaacugugggagcagcuggccaaggaacccgucgaucggugcugccccuucacggguaaaaugaugucaauauccgaccuauucucagacaaagucgaaauagagcacuuacugccauuuagccucacgcucgacgacucgauggccaacaaaacggucuguuucagacaggcaaacagagacaaaggcaaccgagcacccuucgacgcguucggcaauucgccagcaggguacgacuggcaggaaauacucggcagaagucaaaaccucccauacgcaaaacgcuggcgcuuccuccccgacgcaaugaagcgcuucgaagcagacggcggauuccucgaacgacaacucaacgacacgcgguacauaaguagauacacuaccgaauauauaagcacaauaaucccgaaaaacaaaaucuggguaguaacgggacggcucacaucauuacugagaggcuucuggggacuuaacucgauccugagaggacacaacacagacgauggcacacccgcgaaaaagagccgagacgaccaccgccaccaugccaucgacgcaauaguuguaggcaugaccagccguggacuccuccaaaaagucagcaaggccgcaagaagaagcgaagaccucgacuuaacccgauuauucgaaggacggaucgaucccugggauggcuuccgggacgaagucaagaagcacauagacgccaucaucgucagucaccgcccaagaaagaaaucccaaggagcacuacacaacgacaccgcauacgggauaguagaacacgccgaaaacggggcaucgaccguuguacacagaguccccaucaccucccucggaaaacaaagcgacaucgaaaaaguccgcgauccgcuaaucaaaagcgcccuccucaacgaaaccgcgggccuaagcggaaaaaguuucgaaaacgccgugcaaaaauggugcgcagacaacuccaucaaauccuuacgcauagucgaaaccgucaguaucauaccaauaacggacaaagaaggcguagccuacaaaggauacaagggagauggcaacgcauacauggauauauaucaagaccccacuagcucaaaguggaagggggaaauuguaucaagauucgacgcuaaucagaaaggcuucauacccucauggcaaucacaguucccaacagcgagacucaucaugcgccuccguaucaacgaccuauugaaacuccaagacggagaaauugaagaaauauaccgcguacagcgccuaaguggauccaaaauacuaauggcaccccacacagaggccaacgucgacgcacgagacagggacaagaacgacaccuucaaacugaccagcaagucgccaggaaaacuucaaucugcaagcgcacgaaaaguccacaucucaccaacaggucucauaagagaaggauga

SEQ ID NO: 7249 - RNA, 3108 nt, Artificial Sequence
  Cas9 variant
auggaacaacugaacuacauccucggccucgacaucgggauagcaucaguaggaugggccguagucgaaaucgaccacaacgaagacccgauuaggcucauagacgucggcguucgcaccuucaacaaggcggaaguagcgaaaacaggcgaaucacuuagccuaauccgaagacuagcccgaggaagccgucgacucgucaggcgcaaaaagaugcgccuacuaacggccaagcgcuuacuaaaaucagaaggcauucuuuccgaccucgacuucaacaagggcgccauccuaaaccugcccaacaacugcugggaacuccgggucaaaggacucgacaagaaacuaagcgauaaagaaugggcugccguccuacuccacauaauaaaacaucgaggauaccucucccaacggaaacacgaccggaaaacagacgacaaagaacuaggagcacuccuaucuggcgugagcaagaaccacucucuccucgaagaaggagaguuccggacugccgcagaacuugccaucaacguauucugcaacuccaaagggcacauaagaaaccaauggggcgacuacagccacacauucagcagacuagaccugcaaaaagaaauaaaacagcuguucgucagccaaagggaacuggggaacccguacaccaguuccuccuucgaagaaaacaucaucagccugcucaugaaacaaaaagaagcaauaagcggcaacgacauacuaaaaaugcucggaaaaugcacguacgaaaagaacgaauacaaagcugccaaaaacacauacagugcggagcgcuuuguauggcuaacuaaacucaacaaccucagaauaguggacgauggcgucgagcgcgcccuaaauagcucagaacgaaaacuacuaaucgaugaacccuacaagaaagcaaaacuaaccuacgcgcaaguccgaaaaauccucgagcuccccgacagcgcggucuucaaaggaguacgcuacuucgcagacaacgcagaaaguagcacucugauggaaaugaaauucuggcacagcauccggaaagcacucgaaucaaauaaccucaaagacgaauggcuaguacuaaaaaccaaacccgaacuccuagacgagaucggaacgggcuucagcaucuacaaaaccgacgacgacauaaccaguuaccucagcaacaaacucgacaagaaaguccucgacauccugcuagucgaagucagcuucgacaaauucaucgagcucagccucaaaugccuccgcaaaaucauaccacucauggagaagggcuaccgcuaugaugaggccuacaaauauauauacggcgaagucaacaucgaauacaaccuaaacgacaucaagaacccggucguccuaagguccuucucacagucccggaaaguuauaaacgcagucauccgccucuacggcagucccgcacgaauccacauagaaacggccagggacaucggcaagagcuucaaagaacgcaaggccaucgagaagcagcaagagaaaaacagacuagaaaaaguccgcgcggccgaacacuuuaaacaacucuuccccaacuacguaggagaacccaaagccaaggauauucucaaagugcgauuauaugaacaacagcaaggcaagugccuauacaguggcaaaauacuagacauaaaacgccucauggaacacggcuauguagagaucgaccacgcccuccccuucucacggacuugggacgacucauuuaauaacaaagugcuaguccucgccaacgaaaaccaaaacaaggggaauaaaacaccauacgagugguucaacggcaaagacaauucggacagcuggaaacgauuccucgcccucguaaacaauaguggguucuccgcugugaagaaacaacacauccuaaugaaagaaauugacgaagaaggauucaaacaaaggaaccuaaacgacacgagguauauuacccgcuuccuaugcaacuggguagagaacaacauaccccuccucggcaaaggugugaaacguguguucgcaccacagggaaagauaaccgcccuucuacgcucgaacuggggcauacggaagguacgcgaggacaacgaccgacaccacgcaaucgaugcaaucgucgucgcaugcaccacgguaagcauacagcagcggauuacaaauuacgucaaaaacucagaaaucaaccgcaagaucaaacgacagaacuaccuaaaauuccccgaacccuggaaguucuuccgcgaggacaucucgauccguguauucagcaacaacccaauagaagaacugaagcaacaacucagcgaucgaccagaggcuaaccaccaauucgugaccccacucuucguaagccgcgcccccgucagaaaaaugacuggacaagggcacgaggacaccaucagaagcgcaaaacgaaucuccgaagggauuucaguccuccgaguaccacucaccaaacugaacgacaaaagccuagaacugauggucaaccgcgaacgagagaaggagcuauacgacgcacucaaacaacgacuacucgaguucaagaacgauccagaaaaggccuucgcagaaccauucuacaaaaagggcgggcaacaagucaagaccgucaggaucgaacgcguccagaagaacggaguccucgugaacaacaacaccggaauagcagacaacggaaacaucguacgagucgacguguuccucaaaaagaagaaauacuuccucgugccaauauacagcuggcaaguggcaaaaggcauacucccgaacaaagccauagucgcccacaaaaacgaaugcgacugggcagacauggacggcagugcccaguuccucuucucucucuacaccaacgaccucauugaaguaguacuuaaggacucgacgauacucggcuacuucaguucgaucgacagagccaccgcggccaucaucaucaaagaaccagacauggagaaaagcaagggaaaggaaggaauccaccgagucggcgugaaaaccgccaggagcuucauaaaauacaacguagauguccuugguaaaaacauaucccgaugcagaaaagccaaacgccuaccaguccgcuga

SEQ ID NO: 7250 - RNA, 3108 nt, Artificial Sequence
  Cas9 variant
augcuccgcaagaugcacuaccgccuagcccuagaccucggcaguacgucacucggcugggcaaugauaagacuaaacgcaggcaacgagcccugcgccguaaucaaagccggaguccgcauauuuagcaacggaagaaaccccaaagacgguucaagccuugccguaacccgcagggaggcccgagccaugcgccgacgaagagaccgacuccucaaacgcaaagcacgaaugauccaaacccuaauagaauacggcuucuuccccgccaaagaagaccaaagaaaagcccucgaaaucaugaaccccuuugcccuacgagccaaaggacuaaaugaggcacugacucccgccgaguucgcccgagcacucuuccacauaaaccagagacgaggauuuaaaaguaauaggaagacggauaagaaagacaacgacagcggugcccucaagaccgcuaucaacaaacuacgcgaaaccuugaaaacagaaaacugcaggaccguaggagaauggcucaacaaacgagauguagcaggacucacuguccgagcacgauaccaccaagacaagacaauaaaagaggacggaaaaagcaaaauaaacaaauacuacgaccucuacaucgaccgcgcgaugaucgaacacgaguuugacgagcucuggaagaaacaagccgaauuaaacccgacccuguuuacagaagcagccagggcagaccucaaagacguacuucugcaccagcgagcgcugaaaccagugaaacccggacgcugcacauucaugccagacgaagaacgcgcaccccucgccuugcccucaacccaacguuuuaggauguaccaggaaguaaacaacuuacgaauacuccgcgacggccuaaaagaagagagccugacccugaaccagagagacgaccugauagccgcacuagaagagaacaacaaacgcacauucacccaaauaaagaagcucuugggacugggaggcgucgucaaauucaacuucgaagaccccaaacgcgaagaacuuaaaggcaacaccacauccgcgauccucggaaaggacgagcacuucggcuccguaugguucaaauucgacgaagcaaaacaagacgccaucguaaugcaacuuuucaaagaggaaaacgaagcaaaacugcugagauggcuccaaaacgaaacaggaauagaugaaaagagagccgagacaaucgcaaacgucggccuaccagaaggcuacggcagccuaugcgccuuagcccucgcgcgcauccuuccagaacucagacgagacgucguaccauacagcgacgcagccaaggcagcaggcuuccaccacuccgacaccagcaacaaccaggaaguccccggacuaacguucccaauagagcuagucguaacugaaacaggagagauaaaaacuaagcacaucuuucacgaacuccccuacuacggcgaauaccugcaacgucacguaggcuucgguagcgguaagccagaggacuccgcugaaaaacgcuacggaaaaaucgcaaacccaacaguacauaucggacuaaaccaagucagacucgucguaaacacccugaucaaacgcuacggacacccaucagaaguaaucguagagguagcgcgggaccucaaacaguccaaagaucuacgugacgaagaaggaaagcgacaggccgagaaccaaaaacgaaacaaaagaaucagaacugcgaucgcagggguccuccagacgagcgaggagagaguccgacgcgacgacaucgagaaaaugauccucugggaagaguuaucauucgaccccgccgaccgacggugcccauacagcggaguccagaucagcgcagcgaugcuacuguccgacgaagucgaaaucgaacacauccucccguucucccagacccuagacgacagccuaaacaauaaaaccgucgcgcuccgccaagcaaacagggucaaaggaaaccgaacacccugggaagcguucggcgcccaaagcaccgcaggauuugacuacgccacaauacucgcccgcgccgaacacaugccaaaaggcaaacgauaccgauucgccgaagacggcuaccaacgauggcuaaaggaugacgcaggauuccuaccacgcgccuuaaacgacaccaggcacaugagcaaaguagcacgcgaauacaugagucuaaucugccccaacacacggguaauccccggacgaaugaccgcaaugcuacgcggcaaauucgggcuaaacgauguccuaggacucaacggagagaaaaaccgaaacgaccacagacaccacgcagucgacgcgugcgugauagcagucacagaucaaggacuccugcaacgauucgcaaaagccuccgcaucugcaagggaacaacagcuuaauagacucgucgaaaauaugccccuacccugggaaucauaccgggaacacguggagagagcaauagaugcgaucugggucucccacaaacccgaccacagccacgagggcgcaaugcacaacgacacggccuauggucucuugggagacgggaaggucucgauccacaaaaugguggaggggaagcgcgaacgcauagaagaaagccuaaaagucaucgcauucacaaaugcaaaagcaaaugaucgccacggcuugcuugacaauggcgaaccaagacccuacaaaggauacaaaggagacucaaacuacuguaucgaaaucauaaggaacgagaaaggcaaaugggaaggagagguaauaaguaccuucgacgcauaccagcugguacgugaacacgggguggcacgacuccgacaccccacacuaagcguuagcggcaagccucucguaaugcgucuaaugaaagacgagacaauacgcaugguaacuaacgaaaagccaaucaccgcaagaguaugcugggugcgcucagacacccgcaucgcauuugccagcaccuccgaagccaacguagacgcgcgcgacagagacaaaaacgacagcuucucauacauugugaaaacagcaucaguacuccaaaaacuccaggcaagaagaauuucaaucagcccaaccggcgaacuccgggacccgggauucaaagaauga

SEQ ID NO: 7251 - RNA, 3108 nt, Artificial Sequence
  Cas9 variant
auggaacaguugaauuacauccucggccuggacaucgggaucgccagcgugggcugggccgucguggagaucgaccacaacgaggaucccauccgcuuaaucgacguuggaguacggaccuucaauaaggcggagguggccaagaccggcgaguccuugagccugauccgccggcuggcccgcgggucccgucgccuggugcggcgcaagaagaugcgucugcugacggccaagcgccuccucaagagcgagggcauccugucugaccucgacuucaauaagggcgcgauccugaaccugccgaacaacugcugggagcuccgggucaaggggcuggacaaaaagcuaagcgacaaggagugggcggccgugcuccugcacaucauaaagcaucgcggcuaccugucccaacggaagcacgaccgcaagaccgacgacaaggagcucggagcccugcugagcggcguguccaagaaccauagccuacuggaggagggggaguuucggaccgccgcggaguuagccaucaacgucuucugcaacuccaagggccacaucaggaaccaguggggcgacuacagccacacuuuuucccggcucgaccugcagaaagagaucaagcagcuguucgugagccagcgcgagcuagggaacccguacacaucuucaaguuucgaggagaacaucaucagccugcugaugaagcagaaggaggccauuuccgggaacgacauacucaagaugcuggguaagugcacauacgagaagaacgaguacaaggccgccaagaacaccuacucugcggagcgguucguguggcugacuaagcucaacaaccuccgcaucguugacgacggcguggagcgggcccugaacagcagcgagcgcaagcuccugaucgacgagcccuacaagaaagcgaagcugacguacgcgcaagugcgcaagauacucgaguuacccgacagcgcggucuucaaaggcgugcgguacuucgcggacaacgccgagagcagcacccugauggagaugaaguucuggcacuccauccgcaaggcccucgaaagcaacaaccugaaggacgaguggcuggugcucaagacuaagccggagcugcuggacgaaauugggaccgguuucuccaucuacaagacggacgacgacaucacaagcuaccugucaaacaagcucgauaagaagguccuggacauccugcucguggaggugagcuucgacaaguucauagagcugagucugaagugccugcggaagaucauaccccugauggagaagggcuaccgcuacgacgaggccuacaaguacauuuauggugaggucaacaucgaguauaaccugaacgacaucaagaaucccguggugcuccguagcuucucccagagccgcaaagugaucaacgcagugauacggcuguacgggucccccgcgcgcauccauauagagaccgcccgggacaucggcaagagcuucaaggagcgcaaggccaucgagaagcagcaggagaagaaccggcuggaaaaagucagagccgcagagcacuucaagcagcuguucccgaacuacguaggcgagcccaaggcgaaggauauccuuaaggugcgguuguacgagcagcaacaggggaagugcuuauauuccggcaagauccuggacaucaagcgccuaauggagcauggguacgucgaaaucgaucacgcgcuccccuucucgcgaacgugggacgacuccuucaacaacaaaguucuggugcuugccaacgagaaccagaacaaggguaacaagacgccauacgagugguucaacgggaaggauaacagcgacagcuggaaacgcuuccucgccuuaguuaacaacagcggcuucagcgcggugaagaagcaacacauccugaugaaggagaucgacgaggagggcuucaagcagcguaaccucaacgacacccgcuacaucacaagguuccuguguaauuggguggagaacaacaucccguugcucgggaaggguguuaagcgcguguucgcgccccaggggaagaucaccgcccugcugcgcuccaacuggggcauacggaaggugagggaagacaacgaucggcaccacgccauugacgccaucgucguggccugcacgaccgugagcauccagcagcgcaucaccaacuacgucaaaaacuccgagauaaaccggaaaaucaaacgccagaauuaucucaaguucccggagcccuggaaguucuuccgggaggacaucagcauccgcguguucuccaacaacccgaucgaggaacugaagcagcagcugagcgauagacccgaggcgaaccaccaguucgugacgccccucuucgucucacgcgcccccgugcggaagaugaccgggcagggccacgaggacaccauccgcucagccaagcggaucuccgagggcaucagcgugcugcgcgucccgcugacgaagcucaacgacaagucccuggagcuaaugguuaaccgggagagagagaaggaacucuacgacgcccugaagcagcggcuacucgaguucaaaaacgaccccgagaaagcguucgccgagcccuucuacaagaagggcgggcagcaggucaagacgguccgcaucgagcggguucagaagaacggggucuuggucaacaacaacacggggaucgccgacaacggcaacaucgugcgcguggacgucuuccugaagaagaagaaguacuuccucguacccaucuacagcuggcaggucgccaaggggauauugccaaacaaggcgaucguggcccacaagaacgagugcgacugggccgacauggacggguccgcccaguuccuguucagccucuacaccaacgaccugaucgagguggugcugaaggacuccacuauccucggguacuucagcagcaucgacagagccaccgcggcccugauaaucaaggagcccgacauggagaaguccaagggcaaggaggggauccaucgcgucggcgugaagacggcccgcagcuucaucaaguacaacgucgacguccugggcaagaacaucucccgcugccgcaaggcgaagcggcuccccgugagguga

SEQ ID NO: 7252 - RNA, 3111 nt, Artificial Sequence
  Cas9 variant
augcgcauauucggguucgacauaggcauaaccaguaucgggugggcauacguagaaagcaaugagcucaaggacugcggcguucggauauucacaaaagccgaaaacccgaagaacggcaaaagccuagcccuaccccgccgggaagcacgcggcgcucgacgacggcuagcaaggcggaaggcccgccucaacgccauaaagcgccuccuaugcaaggaguucggccucaacgucagcgacuacuucgcgaacgacggggaacugcccaaagcauacgaaaccaccaaagacaccaaaagcccauacgaguugcgaucccucgcacucgaacagaaacuagaacccaaggaacuggccagggucauacuccacauagcaaaacaccgcggcuacggcaacaaacacgccaaaaccggcagugacaaggacagcggcaaaguccucucagccauaaaaguaaaugaaacggccaugaaggacaaauaccagagcguaggggaguaccuuuacaaagaauucuaccagaaacuccgccuagagagcgaaaaaaaaggcaauaacaucacaaaagaauucaaaaacguacgcaacaaaggcgaaaacuacgaacacugcguugcccaggaacaaguccgagcggaacucgagcuaauauucgccaagcaaaaagacuucggcgccaccuucagcgaaaacuucgaaucccaaaucauagaaacugcguucuaccaacgugaccuaaaaucauucgaagauaaagucggcaaaugcgucuucuacgaaaacgaaaaccgagcaccuaaagacucccugucagccauggaauucgucgcccucaccagaauaauaaacacacugaagaacuuagaagaaaaaucaaagaaccuuggcauaggcgaagucuacggcaaagacaaaauccaagaaauucuuaaaaucgugcucgacaagggagaaauguccuacaagaaacuccgcgagauccuccauuuagacgaacacauccucuucgcgaaggauuccaaacucgacuacacgcaaggcgugcaagaagcagaaaaggcaaaauucaucgaacucaaaaaccucaaggccuucaaaaaagcaauggggggcgacuucuccaacuuugcaagggaagaacucgacaaaaucgccaccgacaucacacuagucaaauccaaagaaaaucuugcaaaaaaacuccaaaacuacucugcccuuagcaaggagcaagucgaggcgcucagcaaccuaagcuucgccaaacacaucgaccucagccucaaggcacucgaacaaauccuaccauucaugcgaggggacaaaaccggaaaaugccuacgguacgacgaggcaguaaaaaaagccgagcuccaggagcacagaaagcacaaacagaagggcgaguuccucaucccccuaaaagacuacgaacccuaccuagccaacccaguagucgcccgugcccucuccgaauaccgaaagguccugaacgcccuacugcgcaaauacggaaaaguccacaaaauccaccucgaauucacccgcgaggccaaacucucagcgaaagagcgccaaaaauacgagaaggagcaaaaagaacacuucgaagcuaaccaaagagcuauacaacagugcgaaauacuuggccuacccaucaacggcacgaacaucuuaaaaaugaaacuauggcuggaacaaggugaaugcugcgccuacucgggggagaaaaucacgagggaacaccuacuagacagcaacgcucuacaggucgaucacaucuacccauacucaagaucuuucgacgacucguacaugaacaaaguacucgucuucgccaaagaaaaccaggacaagggcaacaaaaccccauucgaagcauuuggaggcgacaaagagaaaugggaccgcauauuaagucucagcgccaaacucccgaagcaaaaacagcggcggaucuccaacaccaacuuuaaggacaaagaaggaggcuuccuagcacgaaaccugaacgauacgggcuacauugcgaaacucgcaagccaguggaccaaagacugccucgaauucgaggacuuacgagaaaacgaagucacaauagcgggcgagaaaggaucgucaguccacaucgaagucguuagcggacaacuaacuagcaugcuacgccacuacuggggccucggcaacaaggaccgcaacaaccaccugcaccacgcaguagacgccgugaucuuagcuuacacaaacaacgcaaugauaaaggcauucgcgaacuuuaggaagaaccaagaagaaaauaaaaaaaaguucuacgccaagcaaaucgcagaaagcgaguacaaagccaaaaaagccuucuucgaaccaugcaaaaacuuccgacaaagagucgaagagaaaaucaaggaaaucuucgucucgaagcccccaaggaaacgcguccgaggcgcccuccaccaagagacauucuacccguucgaaaaacuaugcaacgacaaagaauacucagagaaguuaaaaauggacuacggcggugaaaagggcaugcagaaagcaaucgcccucgguaaaauuagacaaauaggaacuaagauagucagcaacggagcaaugguacgugucgacaucuucaaagacaagaaaggaaaauucuacgccguaccaaucuauacaauggacuucgcccugggcauacuacccaacaaagcaguggcgaucggaaaagacaaagacggagucaucaaagacuggaucgaaauggauuccaacuacgacuucuguuucucguuguucaaagacgaccucauacucguccaaaaaaaagaaauggaaagggcagaacuaugcuauuucguuuccuucggaagcacaaaugcgcaaaucaacgucgagaagcacaauaacaaauucgagggccucagcgagaacgaaaaaauauuguacuccaacgcaacgcagaaggaaguagcaggaaaaagcauaggaauacaaaaccuaaaaacauucgagaaauaccaagucucaccccucggagaaguacaaaaggcagaauucgaaccucaccaagagaucaaacuaaaaagcagcccaaaaagaaaggacuga

SEQ ID NO: 7253 - RNA, 3111 nt, Artificial Sequence
  Cas9 variant
augcuacacaaaaugcauuacagacuggcacuggacuuaggcagcacuucccucggaugggcaaugaucagacuagacgccgacaaccagccgugcgccgucauaaaagcggggguccgcauauucucgaacggaagaaacccaaaagacgggagcucgcucgcagucacuaggcgggaagcgagggcaaugagaagacgacgcgaccgacuccuaaagcgaaaggcacgaaugaugaggacgcuaauagaauacggcuucuucccggccgaggccgcacaaaggaaagcacucgaaacaaucaaccccuucgcucuacgcgccaagggccuagacgaggcccugacaccagccgaguuuggaagggcacucuuccacauaaaccaacgacgcggauucaaaagcaaccgcaaaaccgacaaaaaggauaacgauuccggggcccuaaagaccgccaucggaaagguccgcgcaacuauagaggcagaaggcugccgaaccguaggagaguggcugcacaagcgagacguugccggacuaacugucagggccagguaccaccaagauaagguaauaaaggaggacgggaagacgaaaauagacaaauauuacgaucucuacauagaccgggcaaugauagagcaagaguucgaugaacuauggaagaaacaggccgaacuaaacccugcccuguucacggaagcagcacgagcggauuuaaaagacguccuacuccaccaacgaccgcuaaaaccagucaaaagcggccgcugcacauucaugcccgacgaagaaagagcuccccuggcacuacccagcacacagcgauuucgaauguaucaagaagugaacaaccuccgcauacuucgcgacggcuuaaaagaggaaccauuaacacuaaagcaacgagacgacuuaauagcugcacucgagaaaaauucaaaacacagcuucacacaaauaaaaacauuacuaggcgucggaggagcagugcaauuuaacuucgaagaccuaaaaagacaagaacugaaaggaaacacuacaagugccauacuaaguaacgacaagcacuucggaaaagccugguucacauucgaugaagccaaacaggacgcuaucguacugcagcuaguaaaagaggaaaacgaggccaaacucguacgauggcuacaagacgaaaccggcauagacgaaaaacgagcagaagcaaucgcaaacgucggacuaccggaaggguacggaucacuaugcgcaaaagcccuagcacggauacuaccagagcuccgcagggacguaaugaccuacgauaaggcaguacaagccgcgggcuucgaacaccauagcaggcugggcagcaacacagaaaucccaggccugaccuucaaaaucgaaagcauagaccaagacagcggagaagucaagcaguuccauauccacaaaguacugcccuacuacggggaguaccuccaacgccacguaggguucggcuccggcgagccagaggaccccgcggagaagcgauacggaaaaauagcaaauccaaccguucacauagggcuaaaccaaauacggcucgucguaaaugcacuccuaaaacgguacggacauccgucagaaguuauaguugaguuagcgagggauuugaaacaaagcaaagaccaaagagaugaagagucgaaacgacaagccgaaaaucagaaacggaacaagaggcugcgcgacgccaucgcaggcacccuaaaaaucagcgaagaacgcguaagacgagacgacauacagaaaaugauccucugggaagaacuaaguuuugaucccgccgacaggcgcugcccguacagcggcgcacaaauaagcgcgaccauguuacuaagcgacgaagucgaagucgaacauauacuaccauucagccaaacccuagacgacagccuaaacaacaaaacggucgcccugcgacaagcgaaccgaaucaaaggaaaccgcacaccgugggacgccuucggagcgcaagccguagcaggauucgacuacgaaucaauacugguacgagcagagggcaugcccaaagcaaagagguaucgguucgccgaaaacggguaccaacgauggcuuaaggacgacgccagcuuccucgcucgcgcgcugaacgacacgcgacacaugaguaaaguagccuucgaguacuuaaaacucauaugcccgaauacgcgaguaauacccggacgaaugacagcgaugcugagagcaaaguucggccucaacgacguacuaggacuaaauggcgagaaaaacaggaacgaucacagacaccacgccgucgacgccugcgucauagcagucacggaccaaggacugcugcaacgauucgcaaaagccucagcguccgcgcgagaacaacaacucaaccgucugguagaaaauaugccacucccguggggaucauacagagaacacgugcaacgggcgaucaacgcaaucuggaucucgcauaaacccgaccacagucacgaaggcgcaaugcacaacgacacggcguacggccuccgaggcgacggcaaggugagcuuccacaaaaugguugaaggcguccgcacacacagcgaagacaacuuaaaagucauagaaaucagcaacgcuaaggccacagacagacacgggcuccucccgaacggcgaacccagacccuacaaaggguacaaaggagacagcaacuacugcauagaaaucgucaggaacgaaaagggcaaaugggagggagaagucauaucgacauucgaagccuaccagcugguucgagagcacggaaucgcaagacuucgacacagcacgcugucaguuuccggcaaacugcuagucaugcgacucaugauagacgacgucgucagacuaauaaucgacgaacaaacaagaaccaugaggauagccacgcuaagcggcaacggacagaucuucauggcggacacaagugaagccaacguggacgcacgaaaccgaagcaaggaagaaacauucgccuacguuucaaaaauggccgguagccuccagaaggccaacgcccggagaauaaacauaucaccaaucggagaacuccgagacccaggcuucaaggaauga

SEQ ID NO: 7254 - RNA, 3114 nt, Artificial Sequence
  Cas9 variant
auggagcgaaucuucggauucgacaucggaaccacgagcaucggauuuagcguaauugauuacucgaguacacaaagcgcggggaacauccaaagauuaggaguaagaauauuccccgaagccagggacccagacggaaccccgcucaaccagcagcgacgccagaaaagaaugaugagacgacaacuccggcggagacgcauacgcagaaaagcgcucaacgaaacacuacacgaggcggguuuccuaccagcauacggaucggcggauuggcccguugugauggcagacgaaccauacgagcuccgcagaagaggacuagaggagggacuaagcgcauaugaguucggcagagcaauauaccacuuagcacaacaccgacacuucaaaggccgagaacuggaagaaagugacacacccgacccagacguagacgacgaaaaagaagcggccaacgaaagggccgcaacguuaaaagcacucaagaacgaacaaacaacacucggagcguggcuagcgaggcgcccacccucagaccgaaaacggggaauacaugcgcauagaaacgucguagcggaagaguucgaaaggcuaugggaaguccagucaaaauuccacccagcccugaaaagugaagaaaugagagcaagaauaagcgacacgauauucgcgcagaggccaguguucuggcgcaaaaacacgcucggagaaugcagauucaugcccggcgagccguuaugcccaaaagguagcuggcuaucccaacagagacggaugcucgaaaagcuaaacaaccucgcaauagccggcggaaacgcacgcccacuagacgcugaggaacgggacgccauacucaguaaacugcagcaacaagcgucaaugaguuggccaggugucaggagcgcccucaaagcccuguacaaacaacgcggagagccaggggcagagaaaagucuaaaauucaaccucgaacuaggcggggaaagcaagcuacucgggaaugcccucgaagccaagcucgccgacauguucggaccggacuggcccgcgcauccaagaaaacaagaaauaaggcacgcaguccacgaacgacucugggcagcugacuacggagaaacccccgacaaaaagagagucauaauccuuuccgaaaaagaccgaaaggcacaccgcgaagcggcggcaaacaguuucguagccgacuuuggcauaacaggagaacaagccgcacaauuacaagcgcugaaauuacccacgggaugggaacccuacagcauaccagcccucaaccuauuccuagcagaacuggaaaaaggcgaaagguucggcgcgcuaguaaacgggccagacugggaaggauggagaaggaccaacuucccacacagaaaccagcccacaggcgagauucuagacaaauuacccagcccagcaagcaaggaagagagggaaaggaucagccaacucagaaauccaaccguaguaagaacccaaaacgaauuacgcaaaguggugaacaaccuaaucggacuguacgggaaaccugacagaauccgcauagagguaggaagagacguaggcaagagcaagagagaacgggaagagauacaaagcggcaucagacgaaacgagaaacaaaggaagaaagcgacggaagaccucauuaaaaacggcauagccaauccuagcagagacgauguagaaaaauggauacucuggaaagagggacaagaacgaugccccuacacaggggaccaaauaggauucaacgcacucuuccgggaaggcagauacgagguagaacauauauggccgagaucacgcagcuucgauaacucaccccgaaacaaaacacugugccgaaaagacguaaacaucgagaagggcaaccgaaugccguuugaggcguucggacacgaugaagaccgcuggucggccauacaaauccgccuccaaggaauggugagcgcgaaaggcggcacaggaauguccccaggcaaggucaaacgauuccucgccaaaaccaugccagaagacuucgcagcaagacaacuaaacgacacaagauacgcggccaaacaaauacucgcacaacuaaagagacuauggccggacauggggcccgaagccccagugaaaguagaagcagucacagggcagguaacagcgcaacugagaaaacuauggacacugaacaacauccuugcugaugacggagagaaaacccgcgccgaccaccgacaccacgcuaucgacgcccuuacggucgcauguacgcacccggggaugaccaacaaacugagucgguacuggcaacuaagagacgacccacgagccgaaaagccagcacugacaccaccgugggacaccaucagagcggacgcggaaaaagccguaagcgagaucgugguaucacauagggugcggaaaaaggucagcgguccgcuccacaaggaaacuacauacggggacacgggaaccgacauaaaaaccaaaucaggaacguaccggcaauucgugacacgcaagaaaauagaaagccucuccaaaggcgaauuggacgagauccgagacccgcgaaucaaagagauaguggcagcccacguggcaggccgcggcggcgaccccaaaaaggcauuuccaccauacccaugcgucagcccaggcggaccagaaauccguaaaguccgacuaacaagcaaacaacaacuaaaccuuauggcacaaacaggcaacggauacgcagacuuaggcucaaaccaucacauagcaauauaccggcuaccagacggcaaagcagacuuugagaucgucagucucuucgacgcgaguagacgacuagcccagcgcaacccgauaguacaacguacgagagcagacggcgccuccuucgugaugagccuagcagcaggggaggcgauaaugauuccggaaggaagcaagaaaggaaucuggauaguacagggggucugggcauccggacagguagugcucgaacgggacacggacgccgaccacucgaccacaacacgcccuaugccaaaccccauacucaaagacgacgcaaagaaaguaagcauagacccgaucggacgagugcgcccaagcaacgacuga

SEQ ID NO: 7255 - RNA, 3117 nt, Artificial Sequence
  Cas9 variant
auggcaaaacaagucagauaucgccuaagccuagaccuuggcuccaccagucuaggcugggcuauauuccgcuuagacgccgacgcccacccuacagccauuaucaaggcaggcguacgaaucuucuccgacggacgaaacgcaaaagacggcuccucccuagcaguaacccgcagagcugcacgcuccaugcgccgccgacgagaccgacuacugcgucgaaaaacccgcaugcucgacgcccuccuugaauacggguucuucccccaggacgcugcgcaacgaaaagcccucgaaaggcuaaaccccuacgcacuaagagcagaaggacuugcccggccacuuacccccggagaguucgcaagggcaaucuuccaucucaaccaaagaagaggcuuuaaaagcaaccguaaaacagacaaaaacgacaacgacagcggagcacugaagacugcaacaucacagcuccgacaagacauccaggcgagcgggugcagaacagugggagaauggcuguggacacaacgccuccaaaagaaaccggaaggcguaccacaccagggagugcgagcccgauaccgcgaaacaccacacaucaacuccgaaggaaagaaacgcaucgaaaagaaauacgaccuguacauagauaggucgaugaucgaagccgaguucgacgcccuguggagcgcccaagcaacauucaaccccguagucuuccacgcaaccgcacacgaaaaacucaaagacauccuccucuaccaacgcccacugcggccgguaaaaccgggaagaugcacacuccuacccgaagaagaacgagccccacuagcccuacccagcacccaaagguucagaaucuaccaggaacuuaacaaccuacggcuacuugucgaucaacuaaacgaacaaccccuaacacuugcccaaagagacacuaucgcaacacuuauggaaggccgcgccaaaauaaguuucgaccagauccgcaaagcacuaaaacuaggaagcaugaccaaauucaaccucgaggacgacaaacgcaacgaacucaaaggcaacgccacgggaagccaauuagcaaagaaagaguucuucggcccagccuggcaccaauucgaugaagcacuacaagacgacaucgucuggcaccuccuaucugaagaaaacgaaagcgcccucaucucuuggcuccaagaccguacgggaaucgacgccgccaccgcgcaagccguauccaacgccucacugccagaaggguacggcucccuaucaaggaaagcacuagaagugauacuaccgcgacuacgcuccgaaguaaucaccuaugacaaagcaguacaggcagccggauuuagccaccacucccaacugggguucgaguaugaccccgacgaugucgaagacuggaucgaccacgccaccggagaagugaaacccauauucaaaagacuaccauacuacggaaaagcacuucaaagacauguagccuucggaucaggaaagccagaggacucacaagaaaaacgauauggaaaaaucgcgaaccccacgguccacauaggucuaaaccaaguacgagucgucgcaaaugcacucaucgcgcgcuacggacgccccaccgaaauaaucauagaacuagcccgggaucuaaaacagagccgggaacaacggcaacaagaccaacgaagacaagcugacaaccaaaaacgcaacgcacggaucaggaacucaauagcccaagcacucgggaucgcagaagcccgaguaagacgcgaagacauacaaaaauggauacucugggaagaacucgacccaggcgacgccaugcaucgcugcugccccuacucgggaguccccauaagcgcaagcaugcuccucuccgagcagguugaaauugaacacauacugcccuucucgaugacacuggaugacucacuaaacaaccggaccguaucacugcggcaagccaaucgcaucaaacgcaaccgaucuccgugggacgcccgcgaggacuucgaagcccagggauggcacuaugacggcauccuacaacgugccggcuuaaugccuguucaaaaacgcuaccgguucgccgccgacggauaccaaagauggcuccgagacgaccaagacuucuuggcccgagcccucaacgacacacgcuaccucagccgaauagcggcggaguaccucaggcucgucugcccacaaggaaccaggguaauacccggccaacuaaccgcacuacuacgacgccgcuucggucucaaugacauccuaggccuagagggcgagaaaaacagaaaugaccaccgccaccacgccgucgacgccugcguaaucggaauaaccgaccacgggcucaugcaaagguucgcacgggccuccgcgcaagcgcgggaacaaggccucacacgacucgccgaagaaaugccacuaccauggccaacauaccgcgaccacgucgaucgggccgugucacuaaucuggguaucucacaaacccgaccacgggcacgaaggagcaaugauggaagaaacagcguacggacuaaugaaagacggcaccaucagacaacgacacaaagccgacggaacgaaggguagggaaguagcaaaugucauucgcauugccgaaccggcacaaccgacccgacacggcgucgacgaccaggggcgaccacugccauacaaaggauacauaggcggcagcaacuacuguaucgaaauaaccagaggcgcgcaaggcaaaugggaaggcacgguaauaagcacauccgaugcauacggcaucguccgagcacguggcauagcagggcuacgcaacacaucccagggacaaaacggacauccccuaguaaugcggcucgugauaggcgacucccuacgacuacgaauaaacgacgcguuacaaaccaugcgcgucacaaaaaucagcggaaaugggcaaguguucauggccggugugcacgaagccaacgucgacgcgcggaauagagacaaaucccaagcauuugcccuagucuccaaaauggccgggucacuccaagcagcccaggcacgccaagccaccaucucgccaauaggagaaauacgagaccccggcuuccccggguga

SEQ ID NO: 7256 - RNA, 3120 nt, Artificial Sequence; identical to SEQ ID NO: 1456
  Cas9 variant

SEQ ID NO: 7257 - RNA, 3123 nt, Artificial Sequence
  Cas9 variant
auggacagacgggaugcgcgagcuaugcgacgccgccgagaccgauuccaacaaaggcaaagagcauuacuaaaauaccuaguugcagacggacuauucccagaagacgaaggggaaaggaaagcacuggcggcccuagaccccuacgcacuaagggcaagggcccuagacgaagcccugagccugcacgaacuugggcgcgcacucuuccaccucaaccaacgaaggggauucaaaagcaacagaaaggcugacagaaaagccgacgaugaugccggcaaaaucgcgauagggguagaccgagcacgggaggcaauggccgaaaacggggcccgaacauacggagaguggcuacacaggagaagggcgagcgcgacagacgcaaacgccaucccacccgugaggacgcgacugagacccgaaucgggagaagacgcaaagggagacggcuacgacuucuaccccggcagagaccuacuggaggaagaguucgccgcaaucugggaagcacaggccgcacaccacccagacgugcuaacggacgauguuuacgaacgccuauuugaaauaguauuuuaucaaaggccacucaaagcaccccagaucggaaugugcacacuaauagccggggaccgaagacuccccaaagcacacccacuauuccaacgacggcgccuacuagaagaacugaacgcccuaaugauaguccgacccggagaaguagcacaacggcucacacgggaagaacgagauacccuguuucucaaacugaaagacagaaacaaagucucauuugaaucacugcgaaagacacucaaacucgacccagacgcaagauucaacaaagaaucagaaaaccgaaccgaauugaaaggcgacgagguggcagcagcaaugggcaguaaaacucgauucggaaauagaugggugcaccuaaguaucgaggagcaaugggcuguaauagaaagauuaggagacguagagagcgacgcagaagacgcggcauucagagcauggcucgccgaacguuacgaacugacaccggagcagacgcgggcaguaacaaacgcaccacugccacaaggauacggcagauucggagagaccgcaacaagaaagcucaucgaugcguuaagagacggagagaaagacgggcgagucuugguguacucggaggccgugacggcggcuggacuaggccaucacuccgaccgcagaacaggggaaguguuugaggacgaagaggggaggccgcagcuaccuuacuacgggguggcacuagaaagacacauaaugcccggaacaggagaccccucagacagcgacgaaaugcgugugggcagauuaacaaaccccaccgugcacaucgggcugaaccagcuuaggcgcauaguaaaccgacugauccgugcauacgggccaccggcggaaauagcgauagagcuagccagagaacuaaaacugacggacgaggacaagaaacgcauaaacaaagagaacaauucaaacagacuggacgcagagcgacgcagcgaaaagcugcuggcgaucggaaaaccagacaccggggcuaacagagcucuacuaaaacuuugggaggaauuaaaccccgcaaauguacucgauaggagaugcaucuacagcggaguccaaaucuccauagacaugcuauucucggcugcaguagaggucgaccacauauuaccguucacagcgacacuagaugacagcaacggaaacaaaauaguaugcacaagagaagcgaaccgggagaaacguaagaggaguccuuacgaagcauggggacacagcgcaaggugggaggaaauugcggcacgggcagcgcaacuacccagaaacaaaagguggagauucgaaccggaugcgauggaaaaguucaaagacgacggcggcuuccaggcaagacaccuaaucgauacccaauaccuagcacggcugucccgggaauaccuggcaacacuauacccagacaagggagaaggcuccggucacauauggguaagcccgggaagacucaccgaaauggucaggcgaaaacugggccuuaacgaccuacuaccagaccacaacuucggcgggggagcagaucaagccaaaaaucgacuggaccaccgacaccacgcaauagaugcaguagugguagcaaucgucgacagaggcaugcuaaacagaauagcacgcgcgucgggccaggaaggggccgaaggcagagaaaggauaauaaucccggaaccuugggaaggguuccgcgacgaccuaagaacagcaguaaacgcgauaacaguaucccaccgaacagaccacggaacagcaagcaaagcagggcuaccgaagggcaaggacgccaccgccggacgacuacacaaugacaccgccuacggauuuacaggagaaucagacgcaaagggcaacagcaucguaguacgacggguaccgcugucauccuucaagaaacucgcugacauugacagaguacgagacccggaacucaaagcggcccucuaccaacaccuagacgggcucgagggaaaagcauucgaaaaagccaucggggaguucggcaguagggaauggcaccccuauggcggcguaaggcgaguaagaguaacagagccacuaagcgucauacccauaagagaccgaaacgggcacauauacaaaggcuacaaaggagacagcaacuacagauacgauguaugggagcuaccaggaggcaaaugggucaaugaaguggugagcauguucgacgcgcaccaacccggcuggcagagcgcaauccgagcagcaaacccaaccgcccgaaaagugcuuagccuccacagggacgacguacucgccauagaacgaaacggcgcugaacgcgagcuagugcgaguagugaaauucuccgaaaaacaguucgccgucgcaccacccaacgaaggaggggcccugaaggcucgggacgcagacaaaggggacccauucaaauacucauaccccaguccgaacacacugaaggcccuaagagcccgacaagugcgaaucgacgaauugggacgcguccucgaccccggcuucccagcaaggaccaagcaacgaaaaacaagaaaaccaaacuga

SEQ ID NO: 7258 - RNA, 3132 nt, Artificial Sequence
  Cas9 variant
augcagagagacaacccacugguauacagacuagcacuggacuuaggcagcacgagucucggcugggccguuuuuagacuggacgcggagggaagcccauuagcaaucauaaaagcaggagcaaggauauucagcgacgggcgcaaccccaaagacgggagcagcuuagcagucacgcgacgggccgcacgcgcgaugagacgaagacgcgaucgccuacucaaaaggaaggcacgaaugcuaggagcuuuagaacgacacggcuuuuucccgcaagacgaaucagcgcgaaaaguacucgaaacauuaaacccauuccuccuaagggcgcaagggcuagaaguagcgcuuaaaccagaagaguucggacgggcacuauuccaccucaaccagcgacggggcuuccaaucaaauagaaaaacugacagaaaagauagcgacagcggagcccuaaaacaagcaauaggcacauugcgggcacagaugcacgaaucgggauguagaaccgucggggaaugguucuggaaggucagaauggagcauaagcccgaaggggucaaaggccaaggaguccgagcgcgcuaccgcgaaaccccauucacaacagaugaaggaaagaaacgaauagacaaacgauacgaccucuacguggaucgagccauggucgcgcaagaguucgaugcccuaugggcagcccaggcggccuucaacccagcacuauuuaacgaagcggcacgagccgaacuccgcgacauccuccuacaccaacgaaaacuccgcccaguacaacccggaaggugcacccuagucccagaagaaccccgagcauuacuugcccuaucaucaacgcagcgcuuucgaaucuaccaagagguaaaccaucugcgcguccuccacgacgaacuccgugaggaaacucugacacuagcacaaagagaccaaaucgucgcccugcuggaaaaacaagcgaaaguaacauucacugccaugcgaaaagcacucggguucagcgcacuauucaaucucgaggaugcaaaaagagaugggcucaaaggcaacgcgacagccgcagcacuaagcaagaaagaccucuucgggccacugugggcuggauucggaaccgcacuacaggacgagauaguaacgcaacuaaugacggaagagucggagccccgccuaauagcguggcugcaagaacacacgggcgucgacgaagcaagggcccaagcaauugcaaauaccgggcuuccagagggauacggaagccuagguagaaccgcacuagccaggaucgucccagaacuccaacgcgacgugaucaccuacgacaaagcaguccaagccgcaggguucgcacaccacuccgaccugggcuucagcuucgagcacggugcagacgaggucgaacgcauaggcgaacgaacaaucgcauccacaggugagaucaaacccguguucgcauucaaacaacuaccauacuacgggcgagcgcuacagcggcacguugcauucgcaaaagacaacccacgcaacgacgaggaacgauauggaaaaauagcaaacccgacaguccacauaggacugaaccaaguaagaguaguuguaaacgcacuuaugcgacgguacggacgcccagccgagguagugaucgaacucgcaagggaucucaaacaaucaagagaacaaaagcuagaagcccagcaaagacaggcagacaaccaaaagcgcaacgcgcgaauacggaggaguauagcggaagugcugggaauaucagaagaaagaguccggacacucgacauccaaaaauggauacuaugggaggaguuaagccacgacgcagcggacagacgaugcccguacagugguguccaaaucagcgcaaguaugcuccucggcgaaagaguagaaauagaacacauccuccccuucagcaugacacuagacgacagccucaacaaccguaccgucgcccugagggaagcaaacagaauaaaacggaaccgcgcacccugggaagcgcgagccgacuucgaagcccaaggguggucguacgacggcauccuccagcgcgcggaaaggaugccgcuaagaaaaagauacagauucgcaccggacgguuacgaaagauggcugggcgaagacaaagacuuccucgccagagcgcuaaacgacacgcgauacuuaagccgcgucgcagcagaauaccucaggcucgucugcccgggaucagccacaaggguaauccccggccaaaugacagcacuccugcgcggaaaauucggacucaacgacguacucggacucgauggagagaaaaaccgaaacgaccacaggcaccacgcggucgacgccugcguaaucggaguaacugaccaaagaaugaugcaacgguucgcgcaggcgaacgcacaagcacgagaagacgggcuuacacgccuaguagaggacaugcccuuacccuggccuacguacagagaccacgucgaacgcgcggugcaccacaucuggguaagccacaaaccagaccacggcuucgaaggggccaugauggaagaaacaagcuacggcauccucagagauggcucaaucaaacaaagacgaaaagccgauggaagcgcaggacgggaaaucagcaaucuaauacgcauagccgaacccggccaaccacagcgacacgggguggacgcagagggccgaccguuaccauauaaaggauauguaggcggcucaaacuacugcaucgaaauuacaguaaacgacaaagggaaaugggaagggcagguaauaucaacguuugaugcauaucgcaucgucagagaaggaggacuccgacaacuccgccacccgacacaagggcagaacggacgcgcucucgccaugcgccuaguaauaggagacuccguacgucucgaagcgggggaaggaucccugcaaacacugcgugucgcgaaaauguccgcggcaggccagguguucaugucagaagucaaccaagccaacgucgacgcgcgcaaccgcaauggggaccuccccuacgucaguaaaauggcgggcucauuccaaaaggcgcgcgcccgccagguaacaauaucacccauaggugaacuacgggaucccggcuucaaaggguga

SEQ ID NO: 7259 - RNA, 3135 nt, Artificial Sequence; identical to SEQ ID NO: 1459
  Cas9 variant

SEQ ID NO: 7260 - RNA, 3135 nt, Artificial Sequence
  Cas9 variant
auggccgagaagaaguucaaguaccgccugggccucgaccuggggaccaacucaaucggcuggugcaugcugcggcucaacaaggacaaugagcccgccgcggugaucaaguccgggguccgcaucuuccacgacggccggaacgagaagaccaaggagccgcuggccguggugcgccggaacgcccgcagcauccggcgcaaccuggaccggaagaucucccgccggaaccaccuccugaacacgcuggucaaguacuuccuccugcccagcaacgagaucgaacgcaaggcccuggccgugcucaaccccuacgagcugcggucccgcgcggucaacgagcgguuggagcuguucgagcuugggcgacuguuaaugcaccugagcaagcggcgcggcuucaaguccaaccggaaggucgacaaggaggacagcuccggcaagaucaagcccgccaucgaacgccugaagaauaagaugcaggagaccaacaagaagacagccggggaguaccucuacagccugaugcagaacggcaagccggugcgggcccgccucgggcgcaucgacggcuccaacggguacgagaucuaccucgaccgggcgcugaucgaggaggaguacaaccugaucaugaacgagcagaagaagcaccacaaggagcucaccgacgacaucaucaacgagaucuucaacaucaucuucuaccagcgcccccugaagaagcagaucaucggcaagugcagccugacgggugaggacaccaagcucaagaaggcccacgugcuggcccaggacuucauccugcugcagaagguccaggaccugcggguguucgacgacaaccagcuggaguuccgcccccucuccaacgacgagaaggacaucaucaagcgggagcugcgcaagaagaaggagguaagcuacgagaacauccggaaauugcucaagaaguacuacgagaacgucaaguaugggauguucucccacgagacccuauacaagaagcugcagggcaacaaaacaaacgcccuaaugagcgacaaggagaucaucggggacuccugguacagccugucccccgaggugcaguacgacaucaucgaggaguuguacagcgacaaggacaacgacgagcucagcaaacuuuacuccgagaaguucaaccugaacgagagccagaucaacggccucuugaacaaggccaucuacagacuugacuccggcuacauccgcuaugggaagacggcggugaccaaccugaacucgaucauggacaaggacaaccucaaccugcacgacgcccgcgaggaggccggcuacgagaaggagaacaagcaggacgccuccgaguaccuggaguacuacgggaagguccucccggacagcgugguggacccccagauugagaaccccaagaacgacgaggagcgguacggcaagaucgcgaaccccaccguccacgcggcccugaaucagcugcgcaagcucgugaacgagcugaucaagcuguacgggaagccggagcagaucgugaucgagcucgcccgggaccugaagaacucccgcaaggccaaggacgucaucaacaagaagauugccgagaaccggaagcugaacgaggagguggacaagacccuccaggaguacagcgagaaguacaacacgcacaucgugaagaacaagcugaaccgcgacaaggucaagcuguggcgggagcucggcaaggacccccuggagcgcaagugcaucuacaccggggagcagaucaacaucgcgaagcuguucuccgacgaggugcagaucgagcacaucguccccuacagcaagacccucgacgacuccuucaacaacaagacccugagcaugaagcaggccaacuacuacaaggggaacaagacgcccuacgaggccuucaaggacuccaaggacggcuacaacuacgacgacaucaucgcccgggccaagcugcucaacaacgacaacaaguucaagcgcuucacaaaggacgcgauggacaucuacaaccgcgacgggaaggacuucaucgcccggcagcugagcgacacccaguaccuguccacccgcgcgcucaucuaccugcagagccuguacgaaaaggcccaccacaguaguaucuggacgaucccgggccagcucacagcgcugauccggaacuaccuggggcucaacacccugaucuccaacgacaagaacaagaaccgcaacgaccaccggcaccaugccguggacgccuucguggucgccgugaccagccgcucccugcuccagaagaucuccuacgccgcgagccugcaggaggaccuggacaaccggaacguguccagcuaccgcaacaagcuccuggagaagaugcccgagcccuucccuaacuaccggaaaucccuggagcucgccaucgacaacaucaagacgagccacaaggccgaccgcuccaucagcggcaagcugcacgaggacaccgccuacggcauagucgagaacgacgacaaguacaacguggugacccgguggaccgucgacaaguucaaggagcagaagcacuucgagacgaucagagacaacgagcugaaggagaucgccugcuccgacaaggagcuguucgcgaagaucguggaaacucggaagaucaagagcauacgcaagcucgccaaggagaacccggugaucaagaucaaggacaaguccgggcgggacuacaaggccuucgccggcgggaacaacaucugcgucgagaucuacgaaguggacggcgugcgcaagagcgaggucauccagcuguucgaugccgcgcagaagggguucaugcccgaguggaugaagaaguaccccaacggcaagcuccugaugcggcuguuuaagggcgacgugaucggauucaucgagaaccgcaaauacaacuacuacaccaucaagggcauauccauagccgaccagaaccucaaguugcuggccaucaacaaggccgaggggaucuucaagaagggucucaacauccuguucgacagcaacaacaagaacucccugaacgcaaagcaguucaacaucagcgugaccggcaucgucacgaagaagaagaccgccgacgugaacuucuggaagaaccggaaguga

SEQ ID NO: 7261 - RNA, 3135 nt, Artificial Sequence
  Cas9 variant
augcuccacaaaaugcgauacagacuagcccuugaccucggcagcacgucccucggaugggccauggugcgacucaaugccaaccaacagccaugcgccguaauuaaagcgggcguccgcaucuucucuaacggacgcaaccccaaagacggcagcucacucgccguaacacgccgagaagcaagaucgaugaggcgacgacgcgaccgacuacucaaaaggaaggcaagaaugaugcgcacgcuaauagaauacggauucuuccccgccaacgaaacacaacgaaaagcucuagaaaaccuaaacccguacgcacuccgcgccaagggccuagacgaagcccuaacaccgucggaguucgcacgggcccucuuccacaucaaccaaaggcgagguuuuaaauccaaccgaaaaacagacaagaaagacuccgauucuggggcccucaaaaccgccauaaaacaacuucacucagugcucgacccccaaggcaacgacggaaagcccagaacuguuggcgaacuacucuacaagcgcuucacagaccuaucuaaauuaccgaaagaccggacgguaagagcccgauaccgccaggacaagauaguaaaagacgacggcaaaacaaaaaucgacaaauacuaugaccuauacaucgacagagccaugaucgaacaggaguucgacgcccucuggaagaaacaaagcgaacuaaacccuauacuuuucaccgaaaacgcccgcgcagaccucaaagauguacuccuguaccagcgcagccuaaaaccggucaaaccaggacgcugcacauucaugagcgaagaagaacgcgcgccccuagccuuacccagcacccaacgauuucgcauguaccaggaaguaaacaaccuacguauccuccgagaaggccuaaaagaagaauccuuaacacugcaacaaagggacgacuuaauaaacgcacuagagaaaaacaacaggagaacauucacgcaaauaaagaaacuucugggggucgggggcagcguccaauucaacuucgaagacccuaaacgcgaggaacucaaaggaaacaccacguccgcgaucuuagggaaaagcgaacacuucggggaagccugguucgccuucaaugaagcaaaacaagacgccaucguacuucaacugauuaaagaagaaaacgaagccaagcuaguacgcuggcuccaggacgagaccggaaucgacgaaaaacgagccgaagucauagccaacgcaggccucccugagggcuaugggagccuuugcauagaagcccucgcacgaauccucccagagcuccguagagacguagucaccuacgacaaagccguccaagccgccggcuucgaacaccacuccaaacucaaccgcaacgaggagauacccgacauuaccuucaaaauagagagcauagaccgaaacuccggcgaaauuaaacaauuccaccuacacaaagaacuaccauacuacggagaauaccuccaacggcacgugggauucggaucaggcaaacccgaggacucgaucgagaagcgauacgguaaaaucgcaaaccccaccguccacauaggccuaaaccaaguaagaguagucguaaaugcccuaauaaagagauacggccacccaagcgaaauaauaguagagguagcccgcgaccugaaacaaagcaaagaccgcagggacgaagaaaacaaaagacaagcggagaaccaaaaacguaaugaacgccugaggaaagacauagccgacauccucggaauaucggaggaacgcgugcgccgagacgacauagagaaaaugauccuuugggaggaauuaucauucgaccccgccgacagacgaugcccguauucgggaguacaagugagcacaguuaugcuucuuagcgacgaagucgaaguagagcacauacucccauucagccaaacacuugacgacucccucaacaacaagacgguggcauuacgacaagcaaaccgaaucaaaggcaaccgcacacccugggaggcuuucggaaccaguaacauaagcggauuugacuacaguggcauccucacacgcgcagaacugaugccaaaagcaaaacgcuaucgcuucgccgaagacggcuaccaacguuggcucaaagacgacgcuggguuccucgcacgagcucucaacgacacaagacaccucaguaaaauagcaagggaauacaugagcuuaaucugcccaaacacgcgcguaauacccggccagaugaccgcaaugcuacgacgaaacuucggccucaacgacguccucggacucaacggagagaagaaccgcaacgaccaccgucaccacgccguagacgccugcgugaucgccguaacagaccagggccuguuacaacguuucgccgcggccagcgccuccgcaagagaaagacaacuaaaccgccugguagaaaacaugccacuacccugggaaucauacagagagcacguccggcgcgcuauagacggaaucugggucagccacagacccgaccacucacacgaaggcgcuaugcacaacgacacugccuacgggcuccgagggaacggccgaguguccuuccacaaaauggucgagggcaaacgcgaauacaucgaagacaaccucaaagugaucgaaauaacagauaccaaagcgauagaccgccacggccuauugccgacgggaaaaccaagaccguacaaaggcuacaaaggcgacuccaacuacugcaucgagauagugcguaacgaaaaaggaaggugggaaggcgaaaucauaucaaccuucgacgcauaccaacugguccgcaaguacggaauaguacagcuacgguacccaguccugucagucucggguaagccccuagucaugcgauuaauccgaaaugacuucguccgccuugaacacgaagggaucacccgcacgcuucgaguaugcaaaaugcgagaagacggacaaguggcacucgcggacguaaccgaggccaacguugacgcccgaacacggacaaaagaaaucugcuauguguucaaaaccggaggcucacugcaaaaagcaaaggcacggcgaauuacaaucagccccauuggggaacuccgggauccaggauucaaggaguga

SEQ ID NO: 7262 - RNA, 3138 nt, Artificial Sequence
  Cas9 variant
augcaaaaagaaaaaccucucgccuaccggcucgcccuggaccuaggcuccacaucgcucgggugggcgguacugcgccuaagcgcccccggggaaccaagcgcaguaaucagagcaggaucacgaauauucagcgacggccgcaacccuaaagacggaagcucccuagcggugacccgccgagccgcccgugcaaugagacgaaggcgagaccggcuucuaaagcgcaaagcccggaugcuggcggccuuagaacgccacggcuuuuucccucaagacgaagcagccaggaaggcacucgaaaaacugaauccauacggcuugcgggccagaggccuagaaagcgcacuaaaaccagaagaguucgggcgcgcgcuauuccaccugaaucagagaaggggcuuucagagcaacagaaaaacagaccgaaaagacagcgacagcggagcacuaaaacaagcaaucggcacccuccgagcacaaaugcacgaaagcggcugccgcacaguuggugaaugguucuggaagguacguauggaacgaaaaccggagggaguaaaaggccaaggaguacgagcaagauaccgcgaaaccccuuucacaacagacgaaggcaagaaacgaauagauaaacgcuacgauuuguacgucgaccgggcaauggucgcgcaggaguucgacgcccuaugggcagcacaagccacguucgcuccagcccuauucaaugaagcagcacgggcggaacugcgagacauccuacuccaccaaagaaaacugcgcccgguccagcccggacgaugcacucugguaccagaagaaccccgagcccuacuagcacuaccgagcacacaaagauuccguauauaccaagagguaaaccaccuccgcguguuacacgacgaacuaagggaggaagcccugacacuggcgcagagagaucagauaguggcacuacuagaacgucaagccaaaguaacguucaccgccaugcggaaagcgcucggguucagcgcacuauucaaccuagaagacgcgaagcgcgacggacucaaagggaacgccacaacagcggcccuggguaagaaagaccuauucggcccccucugggcgggauucgacacggcacugcaggacgagaucgugacgcagcucaugaccgaggaaucagagccgagacugauagcauggcuacaggaacacacgggaguagacgaagcccgcgcucaagccauagcaaacgccggauugccagaaggguacgggucgcucggccgaaccgcgcuagcgcgcauaguaccggaacuacaacgagacgugauaacauacgauaaagcgguacaggcagccggauucgcacaccacuccgaccuaggguuuucuuucgaacacgacgccgacgagguugagagaaucggagaacgcacaaucgccucaaccggagagauaaaacccguauuugcauucaagcagcuuccuuacuacggacgagcgcuacaaagacacgucgcauucgccaaagagaacccccguaacgacgaagaacgauacgggaaaauagcaaacccaacaguacacaucggacuaaaccagguacgaguagugguaaacgcccuaaugugcagauacgggcgaccgaccgaagucguaauugaacuagcaagagaccucaaacaaagccgugaacaaaaacuagaggcccaacaaagacaagcggacaaucaaaaacgcaacgcaagaaucaggcgcucaauagccgaaguccuuggaauaagcgaagaacgcgucagaacccuagacauacaaaaauggauccugugggaagaacuaucacacgaugcagcggaccgaagaugucccuacucaggcguacagauaagcgcgagcaugcuccuaggcgaacgaguggaaauagagcacauucugccauucuccaugacuuuagaugacagccuaaacaaccgaacgguagcauuaagagaagcaaacagaaucaaacgaaaccggacaccaugggacgcaagaacagacuucgaagcacacggauggucauacgacgggaucuuacaaagggccgaaagaaugccgcaacgaaaaaggcacagauuugcccccgacggauacgaaagauggcuuggcgaagacaaagacuuccuggcgcgagcacuaaaugacacacgguaccucagcaggguggccgcggaguaucugcggcucgucugcccaggcagcgcgacgcgagugauccccggacagaugacagcucuacuaagaggcaaauucggacugaacgacguacucggccuagacggcgagaaaaacaggaacgaccaucgucaccacgcgguggacgcaugcgucauaggagugaccgaccaaagaaugaugcagcgcuucgcacaagccaacgcgcaagccagagaagaugggcuuacgcgacucgucgaagacaugccgcuaccuuggccaaccuacagagcacaugucgaacgggcagugcgacacauaugggucagccacaaaccggaccacggauucgaaggagccaugauggaggagacaaguuacggaauccugagagacgguacaauaaaacaacgcagaaaagccgacggcucggccggccgggaaauaagcaggcuaauccgcauaaccgagcccucccaaccgcaaaggcacggaguagacgccgagggacggccacuacccuacaaaggguacguaggcggaucaaacuacugcuuggaaaucacaguaaacgacaagggcaaaugggaaggccaggucauaagcacguucgacgcauacagaaucgucagagaagggggacuacgccagcuacggcacagcacacagggccagaacgggcaagcgcucgcaaugcgacucguaauaggcgacucggucagacuugagguagacgaacaagaaaggguaaugcgaaucgucaaaauaaacggcaacaacggacaaguauucauggcaccgguccaugaggccaacguggacgcgcggaacagugacaaaaacgaagcauucgcuuacaccucaaagauagcagggagcuuccagaaaacaaaagcacgacaaguaacgauaucgccgauaggcgagcuccgcgacccaggauucaaaggauga

SEQ ID NO: 7263 - RNA, 3138 nt, Artificial Sequence
  Cas9 variant
augaaaccccgcaaccuaaacuacauccuaggacucgaccucgguauagcaucagucgggugguccguggucgaaaucgacgaaaaugaguacccgauaagacuaaucgacguaggaguccguaccuucgaacgagccgaagugccaaaaacgggcgaaucacuagcccucgcaaggaggcucgccagaucgaccaggcgucuuauacggcgccgggccuuccggcuccucaaggccaaacgacuccuaaagcaccaccaaaucguaaaugccgaagaacucacccaacuaccuaaucaaugcugggaacuccgagucaaaggacuggacagcuugcuaucuaacacagagugggccgcaguccuacuccaccuccugaaacaccguggcuaccucagccagaggaaaaacgaagcccaaaaugcggacaaagaacucggcaaacuacgagaagggauggacaauaacuccaaacuccuacucgaaaacaacuacagaacaccagccgacaucgccguuaagaaauucgcuguagaggaaggccacaugcgcaaccaacgaggagcauauacccacacauucaacagacucgacauacuagcagagaugcagcuucuuuucaagacccaacgcgaacuagguaguaccuacgcgaacggcgaacucgagcaagcauucugcgaacuccuccuuuggcaaaagcaagcccuaaacaggucacagaugcugucccuaguuggcaaaugcaccuucgaaaaagaggaaaagagggcggcuaaagccuccuacuccgccgaacgcuucgucgcaauccagaaacugcaaaaccuccgaauccuagagaauggcgaagaacgaggacuauucgauagcgaguucucacugcuacuagaaaacgcuuacaaccuaaaaagcggccucacauacaaacaagugcgcaaaauccugagccucagcgaaaacgccauauucaaaggacucccguaccuauccgacgaccuagaaaagcccgagaagacccaauuccuagccuucaaauucuaccaccagcuagccgacauacugaaaaacaacggcuucagcgacgaguggcaaaaacucagccaagagccuacccuccucgacaaacuuggcacagaacucucacuaugcaaggaagagaaugaguucaucgcacaauucaacggcgaacucccggaagccaugcucucuacacucuucaaccauacgaacuucgacaaauuuauccauauaagccucaaagcacuaaauaacauacuccccuuaauggaacagggcaaugacuauacaaaagcauggcgaaaaguauacccagagcccaccaagaaggacgagaaaacccuacccccaaucccagccgaugaaaucagaaacccagucgugcuacgcucccucucccaagcccggaagguaaucaacgccgucauccgccucuacggaaguccagcccgaauccacaucgaaacggcccgagaacuaggaaaauccuacgacgaccgccaaaagauaaagaaacaacaggacaaaaacagcgacgagcgagaccaagccgucaagaaauuccucgaggagugccccaacuucgccaacaaaguaaaagguaaagacauccuaaaaauccgacucuauaucaaccaagacggcaagugccuauauucaggcaaaccguuagacccccaccgccuacuagaaauaggcuacgucgagaucgaccacgcccucccguucagccgcacaugggacgacagccagaacaauaaaguccuaguacuagcgaacgaaaaccagaacaaaggcaaccagaccccguucgaauggcuggguaaagaugagcaccaaugggcccucuucgucgcccgaguaaacggaugccgguucccuuacgcaaagaaacaacgcauucucacaaagaaauuagacgaacaaggcuuccugaaacgaaaucuaaacgacaccagauacguaagcgccuaccuaaugaaacacaucaaagaaaaccugcacuuagucggaaaaggcuccgauaaagucuucgccuccaacggucaagucacaaacuuucuccgcagauguuggggacucgaaaagaaacgagaggagggcgaccgacaccaugcccucgacgccauagugguagcauguucgacagccaguaugcgacagaaaaucacacuguuuaaaaaguaucaacgcuggaaccucaagaccggaaaacauauagaccaagaaacaggcgaaauaaucccgcuccauuucccagcgccgugggacuucuuccgucaggaagucaugauucgcaucuucucagagaugccccaggaagacuuaauaaugcaacucccagacaggccacaggccaaccacgaguucguacaaccacucuucgucucaagagcuccaucccggaagaugagcggccaaggccacgaagccaaauugcgaucggcgcgaaugcucgaagccacagguaaaucaauaaagaaagaguuccuaaccgaccugacaaucaaaaaccucgaacacaugguaaacaaggaacgcgagccggaauuauaccaggcccuagucgaacacuucaagaaauacggagacaaacccaaggagaaauucuucaagaaaggcggcguagagguaaaaagcauccgcauauccaaaacccagaacaaaagcguaaaccuaggaaacaaaaccaucgcagauaacggggacaucguaagaacggaccucuuccucaaaaacaagaaguacuacuucgugaacaucuacgcauggcaagucucaaaaggaauacugccgaaagaaaccacgaccggcaacaucuuagacaacucguacgaguuccaauuuagccuauucaaaaacgaccuucuggaaauaccacaccccaagaacgaaaacgacucaauacucgccuacuuuauaaggcccgacgacgaacgacgcuggauccuaaaguuccaugacaacgcgaaaauuccagacaucuacgggaagaaagacgaaacuuccaucaggcucagcauccaaggccaaaaauucauuaagaaauaccaagucgacgagcugggcaaaaauauccgucccugccgacccacaaaacgacagggcgugagauga

SEQ ID NO: 7264 - RNA, 3141 nt, Artificial Sequence
  Cas9 variant
augaaaauauacuccuuugauauaggaguagccucaaucgggugggcauucaucgaaaacgaaguacuccaagacugcggcauuagaauuuucacaaaggcagaaaacccgaaaaacggggccucccuggcgcuaccccgccgagaagccaggggaguacgcaaaagacuagcgagacgacguggccgccuaaacacuaucaagcaacuucucugcaaagaguucggacuacagcucgaagacuaccuuuccaacgacggugaacuaccaaaagccuauaccgccucaaaagccaacccgcuaaaaagcccauacgaacuaagaacccuggcccuuagccaaaaauuagacagcaaagaccuggucagaguaauucuccacaucgccaaacaccgaggauacggcaacaagcacgccaaagacuccaaggacaccgaaaguggaaaaguaaagaaagcuauagaguucaacaggaaaacgcucgccgaaaaaggguaccgcucagucggcgaauaucuauacagggaguucuuccaacaaagcagaauaagccaaaacaacggugcuaccgaguucgugaacguacgaaacaaaacgggcaacuacgaacacugcguagcccaagacaugcugaaagacgaacucgaacucauauuccgaaaacaaaaagaacugggccuccaccuaagcgauggauucgaaaagcaacuccuagacaaaaucuucgaacaacgaccccuaaagagcuucgccgacaaggucggaaaaugccaauucaucgccggagcaaagagagcccccaaagacucaaucagcgcgauugaguucguagcacugagccgaaucaucaacacccucgcuaaucucucgaagaaauccggcgaaauguacgauaaagcaauggugcuaaccauccucgacagcguacucgaaaaaggagaaauguccuacuacgcucuacgagaagccauaaaccucgacgagaaaauccgauucgcugauagcagacucgacuacagcaaagagaucaaagaaaccgaaaaaguaaaauucgucgagugcaaaaacuuaaaaucguucaagaaaguccucggaaacugcuacaaaacccuugagcgaaaacacaucgacagcaucgccgaacgaauagcugucauaaaagacguagaaaaacuccacaaggagcucgaaucguacugcgcaacugagcagcugagccucacaucagaacaaauacaagcccugagccaccuaaacuucucaagccauaucucacuuagccucaaggcccuagagcagauccugcccuucaugagaggcgaacgcgaggcaagauccuccgacgccgacuacugcauaggcauagacgaaagcggagaaagccaaugccucagguacgacgaaagcguagagaaagccggccuaaaggcccucucaaaggacacccuaaagggccaaauccuaccgccccuaaacgaguucgaacccuaccucgcaaaccccgucguggcccgagcgcuugccgaauacaggaaaguguuaaacgcccuccuaaaacaauacgggucaccccauaaaauacacauagaguaugcccgggaagccaaacuaaacacaaccgaacggcaaaaguacgaaaaggagcagaaagacaacuacgccgccaaccaggccgcacacaagaaaugccaagagcucggccuggaacccagcucaacaaaccugcugaaacuuaagcucuggcaagaacagggcgggcucugccuguacucaggcgcgaagaucacaauaagcuaccuacaggaccccacagcacuacaagucgaccacauauaccccuacucacgaucguucgaugacagcuacaugaacaaaugccucguccucacaaaagccaaccaagagaagggcaaccgcacacccuucgaagccuucggcacagacucggcaaaguggggugugaucacuacacucgcacagaaacuaccccacaagaaacgccgccgcauacucaacaccgcauucaaugacaaagaagccggcuucaaacuccguaaccucaacgacaccagcuacaucgcacgccuuguagccgacuacacggaaaccuaccucgaguuccucagccuggucgaaucugaaaacacaacacuuggcaaaggacagaaaggcagcaaaaagcauauagccaucguaaacggcgcccuaaccagcacaaugcgcuacuaccucggcuucgcaucaaaagacagagauaaccaccuccaccacgcacuagaugcugugauuaucggcuucaugaacgacuccgucauaaaggcguucagcgacuucaagaagacccaagaaacgagcaaagcggcuuacuacgcccacacccuauccaaacaagaauacaagaaacaaagggccuucauacaauugcccuccggggagaauuucagagccaacguccuggaaaaagccgaaagcguuuucguauccaaaccucccaggaaacgcguacgcggcgccuuacacgaggaaucauuuuauucacagaacgacaccaaacugcuaaaauccuacgggggugcggaaggaaucgaaaaagcacuccaacugggcaaaauccgccaaauaggaacaaaaauuguaagcaacggagccaugguaagagucgacaucuucaagcaccgaaaauccgggaaguucuacggcguacccgucuacaccauggacuucgcccuaggcauucugccgaacaaagccgucguccaaggcaaagauaaaaacgacgugaucaaagacuggcucgaaauggacuccucguacgaguucaucuucucccucuacaaagacgaccuccucuuagugcaaaagaaagagauggccgagccagagcuaugcuacuucgucagcuucgacacgucgggcgcgagcauuaaaguagcaaaacacgacaacaacuucuccacgcuaacagaaaaccaaaaauuauuauucuccaacgccacgaaagaagaggucguugggaaauccaucggaauacaaaaucuaaaggucuucgagaaguggcagguuucgguccucggggaggucaaacgcacacagagcuacccccgcgaaaacaucucccucgccucgaaggcaaagaaauga

SEQ ID NO: 7265 - RNA, 3144 nt, Artificial Sequence
  Cas9 variant
augaaacuacuacgcuacauucuaggacuagaucucggcaucgcauccgucgggugggcaaucgucgaaauagacgagaacgacuucccaauacgacucauagacauagguguacgaaccuucgacaaagcagaagucucaaaaaccggcgaaagucuugcucuagcccgccgacuagcccgcagcacccgccgccucauccgacggcgcgcauucagacuacuaaaaggaaagcgacuacugaaacaacauaauguuauaaacaaagaggcccuaacaacccuacccacggacuguugggcucuacgcgucaaaggucuagaugaacggcucucaccuaccgaauggagcgccguccuccugcaucugcucaaacaccguggcuaccuaagucagcgcaaaaacgaagccaaaagugcagacaaagaaaugggugcccuauuaagcggcguggcaucaaaccaccaauugcuagucgaaaaccaauuccggacacccgcggagauagcagugaagaaguucgcacuagaagagggacacauccgaaaucaacuaggagccuacacacacacauucaacagacuagacuuacucgccgaaaugaagcuacuauuucaaacccaacgcgagcuaggaaacccccacacaagcgggcaacuggaacaggaguucugcgaacuucuaauguggcaaaagccagcccucuccggcgacgccauccucaaaaugcuaggaaaaugcacauucgaaacaaacgaguauaaagcggcaaaacacaguuacaccgcagagagguucguguggcuaacaaaacugaauaaccuccgcauccucgaacacggaucagaaagaguacuaaauaccgacgaacgcucacuccuacuaaaccaacccuacgaaaaagcgaaacuaacauacacacaaguacgcaagcuccugggccuuuccgaggaagcgagauucaaugggguacguuacggaaaagaaaaggccgaagacgcuacccucauagaacucaaggcauaccacgcuauccgcaaggcagucgagaaggcagauaaauccgcaugggaaacccugaaaaaccaaacggcacugcuggacgaaaucggaacgacguucagcauauacaaaaccgacgacgacaucacagagcaacugaacggaaaacuuagcgacacaguacugaacgcacuccucgaaaacuuaaacuucgacaaauucauacagcuaagccucaagagccucuacaacauaguaccccugauggaacaaggccugcgauacgacgaagcaugccaacaaaucuauggagaccacuucgggaagaaaagcggcgaaauaaaccgacuacucccacccaucccggcagacgaaauacgcaaccccguuguccuccgcagccuaacacaggccagaaaagucaucaacgcagucauccgccucuacggaucgccagcacgaauccacauagaaaccgcacgcgaacucggaaaaagcuacaaggaccgcaaagaaaucgaaaaacgacaagaacagaacagagcggaacgcgaaaaagcaacagcacaauuuaagacccuguucccaacauucauaggcgaaccaaaagggaaagacauacucaugaugagacucuacgagcaacaaaacggacaaugccuauacagcgggaaaccccucaaccucaaccgacuacucgagaaaggauacguugaaauagaccacagccuccccuuuagccguaccugggacgacucccagaacaacaaaguccugguacuagccggagaaaaucagaacaaaggaaaccaaacgccauucgaguggcucggaaaagacgaacaccaaugggcccucuucguagcacgcgucaauggcugcagauuucccuacgccaagaaacaacguauccuaacccaaaaacucgacgagcaaggguucaucgaacgcaaccuaaaugacacacgcuacaucgcccgcuuccucgucaacuucgucagggaaaaccuacacuuaaccggaaaaggcaaaaacagagucuucgccucaaacggacaaauaacggcguuccucagaggccgguggggccuuuccaaaguccgcgaggagucagaccgacaccacgcccucgacgcaguagucguagcaugcagcacaguggccaugcaacaaaagaucacacgcuucgucaaauaccaggaagggaaccuccaaaccgccgaacgaauagaccgggagaccggggagauaauaccccuccacuuccccgacccguggcacuucuuccgccaagaagucaugauccgaaucuucagcgaaaacccucaggaagacuugauaauacagcuaccagacagaccagaagcuaaccacgaguucgugcagccgcuguucgucagccgcaugccaacccgcaaaaugagcggccaaggccacauggaaacaauaaaguccgcgaagagacucgacgaaggaaucucagucagcaaagucccccuuacccaacucaagcugaaggaccucgacaacauggucaacagagaacgagaaaaagcacucuacgaagcacuaaaagcgcgccugaacgccuucaacgaugaccccacgaaggcguuugcagaacccuucuacaaaaagggaggccaacaagucaaagccguccgagucgaacaaguccagaaaucgggcgugguaguaagaaacggcaacggagucgccgacaacgcaaguauggugcgugucgacguauuuaucaaaggaggcaaauacuuccuaguaccaaucuacaccuggcaaguggcaaaggggauccucccagauagggccgugguagccgcaaaagaugaaucugaaugggaacucauggauaaaaccgcucaguuccucuucagcauguucccaaacgaucuaauccaggugaagacaaagaaagagacuuucuucggauacuacaauggccuugacagggccacaggcgcaauaaaccucaaggaaccagacagcaacaucaacaagggaaagagcggccuccaucgaaguaucggcgucaaaaccgcacucuccguagagaaauaccaagucgacgaacuaggcaaaaacauaaggccaugcagaccgagcaaaagacaagcggugcgcuga

SEQ ID NO: 7266 - RNA, 3147 nt, Artificial Sequence
  Cas9 variant
augaaaagauuaggacuagauauaggcacaaacagcauaggauggugcuuaaucgaagacgacggcgacggaaaaggacgaaucaucgacauaggagcaaggaucuucucagacgggcgcgaccccaaaucaggggcaagccuagccgucgaucgcagggcugcaagagcaaugcggcgccgccgugacagauacuuagggcgcaggacugcauuccuaaaagcacuaaaacgcuucggccuaaugcccgccgacgagucagccgccaaacuacucgcggaccgagaccccuacgagcucagggcccgggcacuggacgaaagguuggaaccacacgagauaggcagagcccuguuccacuuaaaccaacgacggggcuucaagagcaaccgaaaagccgaaaggaaaaccaaagacgcggaagacggaaaaauagccaacggcgcaaaagcccucgaccaagccauggcagaaagcggugcagaaacacucggucaauuccucucgagccgcgacacaaaaagagucagaaugggauccgacgcccaaggcuacgauuucuacccccaaagacgccacguagaguacgaguucgacacaaucuggagccgccagcaacaacaccaccccgcccuacucaccgaagaagcacggaagaaacuccacgacauccucuucuuccaacgcccccuaaaagaacaagaagugggcguauguaccuucguacacaacgaaugcagacucccaaaggcacacccacucuuccaagaacguaggcucuacgaagaagucaaccaacuagaaauaaccacccccggcgccccaaaccgaaaacucacaauggacgagcgcgacgcccuaaucuuagaacugcggucccgcaaagagcgcuccuuugacucacuagccaaacgccucaaacucgccccaggucaauccuucaacaaagcaagcgagagccgaacccggcucagaggagacgaaguauacgcaguaauggcccacaagaaacgauucggagaccgguggccucaccuggacagagacagacaaugggcuauaauaaaacggauaauagaagaagaagauccagacaaacugcacgccuuccugacgggcgaauggggacucacagacgaacaagcccucgcgaccgcccgcgccccucuaccggaacucuacggcagacuaggcccgaccgcaacagcgcgcauacuggaagaacuaaagaaagacgucaucacguacgacgaagcgguccgacgagcuggauggcaccacagcgacgaucgaaccggagaaauacuaccccaacuacccuacuacggggaacuacucacgcgggacaucccgcccggaacacaggacccgaaugauccaccagaacagagaugggguaaaauaacaaacccaacaguacacauaggccuacgacaacucgaaaaacuggucaaugcaauuaucaaaguacacggacgacccgaccaaaucgucgucgaacuggcccgagaacuaaaacucaaugagaaagacaaggaagaacacaacagacgaauccgccgagacaccgccgccgcgcaacucaggagcgcaaaacugcaaucugaaggcaucccggauacaggagcaaacaggauguuacucagaauaugggaggaacuuaacccaggcgaaguccuagaccgacguugccccuacugcggggagcccgugggaaugcgcaugcuauucgcgggggaagcugacauugaucacaucauaccguacucgagaagccuagacgacagcgcaggcaacaaaguaguagcccaccgaagcugcaaccgagcaaaaggaaaucgcacaccguacgagaaguggguacaugaccccgaccgcugggacguaaucucaacccaggucgccaggcugcacaagucaaaacaauggcgcuuugggcccgacgcgauggcacgaguagagaaggacggcggcuucauagccaggcaacuaacagacacacaguaccucucgcgucuggccgggcgcuaccucucgucacuuuacccgacaaaagacgacggcagugucuacgucauacccggccguaugaccgcaauguugcgaagaagaugggggcuaaacagucuccucccagaccacaauuucguagacaacgaacacucaaacgcaccgaaaaaccgauuagaccacagacaucacgccauagacgcagccgucguagcugucacaacccgugcccucaugcaggaaaucgcacgaaccgcaggacgagccgaagauaaagaccuagaccgcuuauucgaggaucuaccucaaccaugggaaggcuucagagaagaacuuggcgaaaagcuaguucgagucacagucagccacaaaccugaccacggaaggaaaggccucccacccaagaaccgagacgugacagcuggaagacugcacaacgauaccgccuacggccugacaggcgacguagcagcugaugggaaaacacccauagugguccacagggucccauuaaugucccucaaaccagcagacauaagcgaucccgaucguauacccgaccccgcacucagaagcgcccuccauagagccaccgauggacucagcggcaaggccuacgacgcagcacucgcaggcuucgcaaaaacccacccccaguuugccggaauaagacgcgucagaguucgcgaaccacucacagucauaccgaucgcggaccgcgacgguagacccuuuaaggcuuacaaaggcgacgccaacagccgcguugacauauggagaaugccagacggaaaauggcucuccgacguagucacaauguacgaggcucauagaagagaccacucggaccggcgaccccaccccgcagccaagaaacucaugucccuacgccaaaaugauaugaucgccguagaacgagauggagcacccagacaaauaaugguagucaaacaaaucuggccgacccagauaaaccuaguagaacacaaagaaaccggaaaccuaaaagaccgucauucaaacgagacagauccauucagauucuucgcccccaccgcggguggacuuaagaaaaugaaagcacgccaaguccgaaucgacccucucggccgcaucuuugacccaggcccacgcuga

SEQ ID NO: 7267 - RNA, 3147 nt, Artificial Sequence
  Cas9 variant
auggccaacaucgcagaaaaccuuguauucggcaucgaccuuggaaucggcagcugcggcugggccguccucaaccaaaaagccaaagacgaaaacaucgucgcacucggaagcuggugcuuugacguaccagaaacagacaaggaaagaauccccacaaaccaaauucgacgcgccaacagacuacuccgacgagucauucggcgucggcgaaaccgaauggccgaaaucagaagacucuucgcaagcaaaggaaugcuagacacggcagaccccgaugcguuagcgaaaaucucagccgacccgugggagaugcgggcaaaaggacuagacuaccaacucacaccgcaagaguucgccguggcccugggccacauagcgaaaaggcgcggcuucaagagcgccgccaaaagaguaucaaccaaugccccauccgaagacagcaaaaugcucgcggcgcuagagaaaacaaaagaacaauccgcacaauaccgaaccaucggcgaaauguucgcccgcgaccccgcauacgccgacagacgacgaaaccgagacggaugcuucgaccgaacaaugucgcgagaagaccucuuuaaagaaacccaaauauuauuugaaagccaacgccggcucgguaacuucagcgccacaucagagacagaacaagcguucauagacauagccuuccgacaaaagcccaugcaagacagcgaaagacucgucgaaacgugccuauucgaaccggacgaaaaacgagcaagccgcuucgccccgagcuucgaaagguuucgacuacucugcaggcuaguaaaucuaagggucacagacgggcuagaggaccgcccacucaccccagaggaacuccgacuagcaugcgaggacgccggaaaaaccagaaagcucagcgucaagaaagucagaagccuuauaggccuccgagacgaccaaagguucaccacaauacccccugaucaagaacaacacgacauagcugcgagaacgggcgacgcgcuaaccggcaccgcaacauuccgagcaauccuaggagagaguuucuggcgccaacuccugccucacccagaacaacucgaccgagccgcguggaucaucucauuccaugaacuaaccgacaccauaaucagcaaacucgcaacgaucggacuacccuccgaagucauggaacuaauuagaaaggcccuagaggacggcaaauucucaaaauucaaaggagcugccagccuauccgacaaagcagcaagaaaacuaauaccguuccuacaggaaggacuaacguacgacaaggcaugccaaaaagcuggguacaaccacgcggcaagcaaauuuacccacuacgacaguauagacacaaaggcaaaguucaacagucucauggacgacguacgggauagcaucacaaaucccgucgcccgaaaagcgauaucagaaggcaugaagcaagucugggcaaugcgcaaccaauggggccuucccggagcaaucugcauugaacuagcgagagacgucggcaacagcgccgagaaaagacgcgaaaucgagucgggcauaaagaaaaauaccgcccagcgagaacgggaaagacaagaagcaaaagaacaccucaaccaauccgacauuuccagcgagacccuccucagguaccgacucuggaaagaacaaggcggacgaugcugcuacaccgaucagcccauaacgccaucacaacucaucgcaagcgacaacuccguccaaguggaccauauacugcccuggucccgcuucggagacgacagcuaccucaacaaggcuuuaugcaccgcaaaagcaaaccaagaaaagaaaaaccgaacccccugggaguggauccacaaccaaaaaggugucgaagcauggaaccacuuuacagcagcagucgagucccgaaaagagaccagaggacugaagaaacgaaacuuccuccucaaaagcucaaaagaaaccgaagaacgguuccgaagccgaaacuuaaacgacacaagguacgcagcccgaguaauggccgaagcaguccggcuccucuaccccagcgggaaccgcgccgaaaaaggcggugucaaacgcguuuucaccagacccggagcccucacagccgcucuccgacacgccuggggagucgaaucccucaaaaagaucaaugggaagcgacuaaacgacgaccgccaccacgcucuagaugccgccguaguagccgcaguauccgaaaaagaaauacaaaagcuaaccaagagcuuccaaaucugcgagcaaaaagggcuagcucgcccaaugagagacguacccaugcccugggaaggguucagacaccaguuagagacggcauacgccgacauacgaguagcgcgcccagagagacguagagcgagagguaaagggcacgacgccacuauacgacaacuucgcgaagaaaaagacggccccguggucuaugaaagacgagcgauaagcgacuuaaaacuaaccgaccuggagcgaaucaaagacccagagcgcaacucagcuauaaucagcagccugaggacuuggauagaaaaaggcaaacccgccgacuauccaccacaaucccccaagggcgacgaaauacgaaaaauacgaguuaugucgcgaaacaaacccgccguaagcgugcgcgggggcaccgcggaccgaggagagaugacaaggguagaugucuucaccaagaugggaaagaaaggaaaacccgaaugguucuuagucccaaucuaccggcaccaagucaucgaccgcauccaauggccacaacccccaaaccaagcagcggcaaacggaaaaucggaaaagaacuggcccaccaugggccucgaacacgaguuccgcuucagccuguaccccagaagcuacguccagauagucaagcgcgacggagaaaucauagaaggcuauuucgcgggucuugaccgaaccgucgcagcguucagucuauuaucaagcucagaccccacgagcauccaacgaggcaucggcgccaaaaccuuagaaucaauccgaaaauacaacgucaaccgguucggcgacaucaguaugguagaacaggaaacacgaaccuggcacggcgacgugugcauaucaccagaccaacccgacucggccuga

SEQ ID NO: 7268 - RNA, 3147 nt, Artificial Sequence
  Cas9 variant
auggucgagaaaauauuagggauagaccuuggcauaucguccuuaggcugggcggucgucgaauacgauaaagauaacgacgaaaacaacaagauaauugacugcggcguacgacucuucaccgcugccgaaacccccaaggaaaaagaauccccuaacaaagcccgcagggacgcccggggacuccgccgcgucaucaaacgccgccgcguacgaaugaacaccaucaaaaaccuccucaucaccuacaaacugaucgacaagacccuccucgacgaagaaaugggcauguuccacucccaaaguaacagaguggacguguggaaacucagacacgacgcccuauaccaccuucugaguggggacgaacuagcaagaguucucauccacauagccaaacacagaggguacaaauuccuaggagaugacgaaagcgacgaagaaucagguaagguuaagaaagcaggcgccgagcuuaaaaagaaauuccucgaagccggaugccagucagucggcgaguggcuguggaaagagagaggacuacaggggaagaaaaggaacaaaucaggcgacuacgaaaucucgauaccccgagacuuccuagucgaagagauccagcguaucuucgaaacacaacagaaauucggauccacauucgcaacauccgaacuccaaaaagcguacacagacauagcguucuauguaaaaccgaugcaauccaucgaggacauggucggcuacugcaccuucuacccaaaaaucaaguccaaaaaccaagauggggagaaaagggcaccuaaagccucgccaucagcugaacaauucgucauacucuccaaaaucuuuucgaccaucgucaucgacgaaaauaaacaggagaaaaagcucaucgaacugaaaucuauagaacaacugauccaaaucgccagaagcaaagagacccugaaauacaaacaacuacgaaaagagcugaaccuggccaaagacauaucauucaaaagcauauccgacgaagagaagaccuggaucaaccuaguaggcaacgcgaaauucaagaaaauccuaggccuaaacuacgaaacauuccugaaaaacacagagaucagcgacgagaucgccaaaauccucacauacgacaaaacguucgaacaaaaagagacgaaacugaaaaaccuccuaguaaacaucgacuggaucgacaacaaccacaucgcggaacuggccaagcugagcuucagccaguucaaccaacuaagccucaaagccauaaaaaucaucucgaaaauaaugaucgagggguacgcccguuacgacgaggccguccaauacgccuucgaaaacaaucuucuccccaagccaucgcacgaaaagagcauccuacuacccccucuuaaagagaccaacaucgcaauccucaacccaaccgucauucgagcauuugcccaauuccgccaaguugccaacgcccuagugagcaaauacgguuccuucgacaaagugcacuucgaacucgcacgcgaaguaaacaccaaggaagaccgcaaacgcugggagaaggaucgcgacaagaaugagaaaaugcauaggcaaaucaccgaaaagcuaguggaagagggagucaaacccagcuacaaaaacauccucaaguccaagcuacgaagcgaacaaaaagauaccugccccuacugccaaaagaaccuccacuaccccaugaucuucgaggacggauaugccgagauagaccacauacuaccacucagccaaucgcaagacgacagcuacguaaacaaaguccuaguccauuccgcaugcaaccaaaacaagaaaaacaggacacccuuugagugguuccaggacgaaaagaaagacugggacaccuucaaaucauacauccugauggaaucaacacucggagaaaagaaacgcaacuaccuuaucaaagaaaacuucagcgacccccaaucccgcaaagaauuuaucucccgcaaccucaacgacacgcgcuacaugagcaaagcgaucaaaacauacugcgagaaccacuggaaacuaagccacgacgaugacaaacuccgaauacaaguaagauccggaaaacuaacgaguacccuccggcaccaaugggggcuagauaacaaaaaccgggaaacucacacgcaccacgcaauggacgcaaucaugaucgcuuucucaacccaaggcauggucaagaaacuaagcgacuacuucgccaagaaagaagcaaaaguagaaaaagacaaaccaguacucaucacccccauaaagcaauucaaagaagcagucgaacaagccaccacccucgaacgccaagagucgauacaaacgaaagcuggagauaccaucacgcucaaccgccuccucaucucccgacccccaagagcauccgugaccggagcggcccacgaacaaaccgcgaaaccuuaccccagaaucaaacccaucaaaaacaaauacaagcgacgccgcauacccaucgacgaggacaaguucgagcuguuccguaacgacaaaguggccucuggcaacgacaaaaauuucuacaacucaagcaccaucccccggguagacaucuacaagaaggaugacaaauaccacguuguaccaauuuaccucucagauaugaccaaagccgaaguccccaacaagaguuuaggaaccaaccccgaagggauggacgaaaaauacuucugcuucagcgucuucaagaacgaccuaauagaacuugaaacuaaagccacccccaaaaagcccuccaagaagcuccuaggauacuucaaacaguuaaauggagcaaacuucauccucaauagcauccacaauggcauaaucgacgguuucguguguagcccaaucacccucuucaaacagcaaaaagacaugugcaagaaaugccucccggaagaucgggccauuggcaacuguucccaagaaacacuagaguucugggaagcagaaaacauaaaagucccaaagaaagacuucgaaugugaccaagguaucaaauucgccauagcaguccgaaaauacaccaucgacccucucggguacuaccacgaaguaaaaggggaaaaacuccucggcacgaucccccagggcgccaagaaacacccgaaacgccaaaaguga

SEQ ID NO: 7269 - RNA, 3150 nt, Artificial Sequence
  Cas9 variant
augauaaaugaaagacucaccuucgggauagaccucgggaucggaagcugcggaugggcagugcuacgccacgcagacgcagcgggagaacccggggugauagagggacuagggagcuggugcuucgacguccccgaaacguccaaagagagaauacccaccaaucagguacgcaggagcaacagacugcuccggagagugauucggagacgucggaaucgaauggcagaaauaaggcgccuguuccacgcgcaggggcuacugccgucagccgacgaagaugcccuaaaaagaccacgccuggacccgugggaacucagagcaagaggacuggaccaaugucuaucugcagaagaauuugcagucgcccuaggacacauagcgagacaccggggguucagaucgagcgcaaagcgcaaagcggcaaacacaucgggcgaggacucaaagaugcucucagcccuguuggucacacgggagagaaccgcacgauauagaacaguaggagaaauguuugcccgggauccggaauacucagcacgacgaaggaauagggacggaauauuugacaggacuguagcacgagacgaccuaauacaugagguaggcaaacuguuugaggcacagcgagcacgcggaucagcauucgcaagcccagaccucgaagcagacuucaaugccaucgcauuccgccaagcggaaaugcaagauagcgaaaggcugguagggaacugcccauucgaacgggacgaaaagagagcggcaagaugggcgccgagcuucgaaagauucagauuauugaccaggcucaucaacuuacggauagcaacagcagaaggggaacgcagauucacaccagaagaccuagcacgcguaagcgcugaacuaggcgccacagccaaacucccggucucgcgcgugagagcgcuaauaggccuguuaccggacgagagauuuacaacgauaagaguagaggacgaagacagagacauaguagcaagaacaggugaggccgcgccagggacguggagacuuaggaaaacccucggggaagcauuaugggcggaaaugcaagcccgacccgaccaacuagacgcaaucgcacacguacugagcuucuucgaggcgacggcgaaaauaagaagcgaacuagaccgccuuggccugccagccgcagucaucgaagcacucgacagaggccuagaagacggagcguuugcaaaauucaaaggagcagggcacauaagcgcgaaagcaugcagaaaccuccugccgcaccuacaacagggccaccgauacgaccaagccugccggcuagccggcuacgaccacgcugcgagcacgcugagccauaccgcacaagucgucaguaaagcgggcuucaacgcgcuagugacugagcuaggagagagcaucgccaacccgaucgccaggaaagcacuaaccgagggacuaaaacagauacgagcuaugugugcaagauggggccuacccggagcaauacacaucgaacuggccagggaagucggcaauaguauagaaaaacgcagggagcuggagucacaaagagaaacgacaacgaaacggcggcaaaccgaaagagacgaaaucaggggacucuuagcacuagaagacgucgacgacgacacauugcuaagauaccgccuguggaaggaacaaggcggcaaaugccuuuacacaggaaaggacauccaugugcgacagcuaauagccacggacaacagcguacaaguggaucacauacugccauggagccgauucggcgacgacagcuucaacaacaaaacgcucugccucgcgagcgccaaccagagaaaaagaggccaaacgcccugggaaugguucucccugacaggcacgccggaagcgugggaggucuucgcgagcaggguagaaaccucgaaagaucuaaggggauuuaaaaagcgaaaccuccuauuaaagaacgccgacgaagucgcacaaagguucagaagccgaaaccugaaugauaccagauacgcggcacgccugcucgcagaagcagcgaaacuguucuaccccgcaggcgaccggcaagaaaaggacggcagaagacgcguccuaacacgaccaggaccucuuacagccgcccucaggcacgcguggggacucgagagccuaaagaaagcggacggaaagagagugagcgacgaccgacaccacgcacuggacgcauuggcgguagcggcgauaucagaacgagagguacaaagauuaacaaggagcuuccaggagugggaacaacaaggacuggccaggccucuacggcacguagcgccgccguggcccggguucagaggggacgugcuagcugcauacgcacaggccuucguagcacgaccagagaggagaagggcgagaggcaaaggacacgacgcaagcauaaggcaagucguaggggaaggaccagaagcccagguguucgagcgaagaggacuggcugaucugaaagaagcagaccuagaccgggugaaagacccggaaagaaaccaggcaauaauagaggcagugcgcgcguggauccuagccggaaggcccgccgacgccccaccgcggagcccaaggggagacgugaucguaaaauugcgaacggcgccggccaagaaaauaaaaccagcagugccaguucggggaggaaccgcggaccggggagacaugguaagaauagacguauucacacgaccaaaccgaaaaggccgggacgaaugguaccucgucccaauauacccacaccaagucaugaacagaaaggccuggccacacccaccaaugcguaguguggucgcauauaaagacgaggccggguggacugagaucggcgcggaacacaguuuccgcuuuucgcucuacccccgaagcuacgugcaacugguaaaaaguaauggagacgucaucgagggguaccuggugucaauggaccgaagcacgggagcuuuccggguguucgugcacaacaacccagccgagauggcgaagggaauaggagcgaagacccugcucaaccuacgaaaauucaacguagacagguucggcguuagaacagaaguaaagagcgaagucaggaccuggcacggggaggucugcacgagcccaguaccacccgauuga

SEQ ID NO: 7270 - RNA, 3150 nt, Artificial Sequence
  Cas9 variant
augcaacucucaaaacuuaacuacauccucggccucgaccuaggcaucgcauccgucggcugguccguaaucgaaaucgacgaaaccgaaaugccuauucgccuaauagacguaggcguacgcaccuucgagcgcgcggaagugcccaagacgggagaaucguuggcacuagcucgacgcuuggcccgaucgacucgcaggcucauucgccgcagagcauucagacuccuuaaggcaaaacgccuacucaaaaaccaccaaauuguauccgcggacgaacuauccacacuaccaaaucacugcugggaacucagggugaaaggacucgacgaacgacuaaccugccaagaaugggccgcaguccuccuacaccuacuaaaacaccgcggcuaccucucccaacgaaaaucagaagcccaaaacgcggacaaagaaaugggagcacuccugucgggcguugcgaacaaccacaagcuccucagcgaaaaccacuacagaacuccagccgaaauagccgucaagaaauucgcccuggaagaaggacacaugcgaaaccagcgcggcgcguauacacacacauucaaccgccucgaucuucuggccgagaugaggcuucuuuuccagacacaacgcgaacuaggaagccccuacgcuaguggcgaacuggagcaggaguucugcaaacuccuaauguggcaaaaaccagcccucuccggugacgccauccugaaaaugcucgggaaguguacacucgaaccaaccgaauauaaagcagcgaaaaacacauauacggccgaacgcuucguauggcucacaaaacuuaacaacuugcgaauccuagaaaaugguagcgaaagagcacugaacgcagacgaacgcgcgcuacuucucaaccaacccuacgaaaaggcgaaguucacauacgaacaagcaagaaaacuucuacaacuuaacgaagcagcuagguucaacagcgucagauaugggaaagaaaacgccgaaaagagcacacuaauggaaaugaaggcuuaccacgccauacgaaaagccguagaaaccgcagacagcagugcaugggccacacucaaaacccaaccccuacuacucgacgagaucggaacagcguucagcaucuacaaaacagacgaggacauaaaaacgcaacuucaaggcaaguuagccgacaacguaaucgacguucugcuugaaaaccuaaacuucgauaaguucauacagcugucacuaaaggcgcuguacaaaauacucccccuaauggaacagggacuccgcuacgacgaagcaugcucccaaauauacggcgaccacuuuggcaaaaaggaacagaaaaacgaucggcuccugccccaaaucccggcggacgaaauccgaaacccggucguccuccgcaccuugagccaagcacgaaaaguuaucaacgccguaauccgccuauacggaucccccgcacgaauccacauagaaaccgcccgagaacugggcaaaucauacaaagaccgcaaagaaauagagaagcgccaagaacaaaaccgagcagagcgcgaaaaagccguagacaaauucaaagaacuuuucccuaacuuuauaggagaacccaaagcuaaagacauccuaacaaugcgacucuacgaacaacaaaacggucagugccucuacuccgggaaaagccuagaccuacaccgccuccucgaaaaaggauacguagagauagaccacgcccuaccauuuucacgcaccugggacgacagcuucaacaacaaaguccuaguccuagcgggagaaaaccagaauaagaguaaccagaccccauuugaauggcucggaaaagaugagcaaaagugggcacuauucacggcccgcgucaacucgugccgguuccccuacuccaagaaacaacgcauccuaacaaagaaguuagacgacgaaggguuuauccagcggaaccucaacgacacaagauacaucgcaagauuccuaguaaacuuugucaacgacaaccuacaccuaacagggaaaggaaagagacgaguguucgcgucgaacgggcagauuaccgcauuccugcgcggccgcuggggccucacgaaaguccgcgaagaaagcgacaggcaccacgcccuagacgccguaguaguagcgugcuccacagucagcauccaacaaaagaucacccgcuuugucaaauaccaggaaggcaaccuccagaccgccgagcgaauagaccgagagacaggagaaaucaucccacuacacuucccggacccaugggcuuucuuccgggaagagguaaugauccgcaucuucagcgaaaugccccaagaagaccuggucaucaaacucccagacagaccacaggcaaaccaugaguuugugcaaccccuauucguaucacgcaugcccacacgaaaaaugucgggacaaggccacauggaaaccaucaaauccgccaaaagacuggacgaggggaucagcgucagcaaaguaccacuaacccagcucaaacugaaagaccucgaaaacaugguaaaccgagaccgagaaauagcacucuacgaagcacucaaagccagacuuacagaguucaaagacgacccagcaaaagccuucgcugaaccauucuacaagaaaggaggaguccaagugaaaagugugagaguagagcaaguucagaaaagcggagugguaguacgcaacgggaacggcguagcagacaacgcaagcauggugagagucgacguauucaucaaaggcggcaaauacuuccucguccccaucuacaccuggcaaguugccaagggcauccucccggaucgagcggucauugccuacacgccugagaacgaaugggaacugauggacgacucagcccaauuccaguucucaauauauccaaacgaccucauaaaauugaccaccaagaaggccaucuucuucggcuacuauuccggguucaaccgacucaccggagccaucaacaucaaagaacacgaucuacagauaagcaaaggggauaaagggguacaccucgggcucggagucaaacuggcacuaaguuuagaaaaauaccagguagaugaacugggcaagaacauacgaccaugccgacccacacaacggcaaaacguacgcuga

SEQ ID NO: 7271 - RNA, 3153 nt, Artificial Sequence
  Cas9 variant
augucuagcuaucgguucuccuucgaccuaggaaccaacucaauugguugggcuguauucgaacucgacccaaaaacaagaccaguagcacuagcagacugcggcgugcggaucuucccugacggacgaaauccaaaagacaaacaaagccuagccgucgcccgucgagaggcacgcgcugucagacgccggcgagaccgauaucugaaaagaagauccgaacuuauggaacgacucguagcaaaaggacuaaugcccgaaucaagagacgaccaaaaagcucuagaaggccucgacccauacgcacugcgggcagccggccuagacgacgcguuacccccacaccacuuugggagagcacucuuccaccuaaaccagagacguggauuuaaaucaaaccguaaaacagaccgcggcgagaacagcgaaaccggaaucacgaagauaggaaugaagaaacuccacgaggcgcuacuauccgaaggcugccgaacccuaggcgaacuacagcaccgacaccacgaagccaaccagacaccggccauggauaccaaccccaaaucagucagaaguaaacuccgaggcgaaggcgccaaagccguauacgauuucuacccaaguagggacgccguggaagacgaguucaacaaacuaugggacucucagaaaagguuccaccccgaccuauuaacagauucagcacgggacgcaauacgagacgccaucuucuaccaacguaaacucaaaacaccagacgccggccgcugcagcuucaaccccgccgaagaacgugucgcgcgagcaaugccaaucgcacaacacuuucgcauccuacaauucgucggggaccuucgccucaucgacaacgaccucguucgacacccgcucaacaacgaucaaaagaaagcauuguaccgagaccuacucgcaaaagggaaacuaaccuucaaagcgaugcgcaaaacaaucggcaucggcucagaauacgcauucucacacgaaagcgaaaaacagagcgaguucaggggcgacgaaacagcagcaagacucgccggacccaaauacuucggcccaaaguggcgagaacucuccuucaaugaccagagcgaaaucgucgacagacuccuacacgaagaaaacgaagagacccugauacaauaccuacaagacagauucggguuugaccacgacaggugcgaaguaauagcagacgccccauugccggacggccacacucggcucggcaaaaccgcacucgaaaccuuaguagaaauaaugagagacgaccaccuacccuacgaccaggccugcacgaaagccggcuacgaacacgcauuaccuccugacggcguaauacuagacgaccuuccauacuacgggauagcacuagaacgccacguagcauucggagauggaaaaucagaaaaccccgaaaaacgcuacggaaaaaucgcaaaccccacgguacauauagcgcucaaucaacuacggaaggugauuaacgcccuaauagcaagauacggucaccccgaucaaguaguaauggaaauugcccgcgaccugaaacaaucuaaagcgaaaagagacgacaucagcaaagaacagaaaaagaaccaagaccgcaacgaccaacgcagaaagaaacuccaagaagcacacaucgccguuaacgcggaaaacaugcuccgcaugcgccugugggaggaacucgacgaagacaacgccgcggcacgcgccugcccauucaccggagagaccaucuccauggcacgccucuucucaccagaggucgaaauagaacacauccucccuuuuucacguucacuagacaacucacccgccaacaaaacauuaugcauggucugggcaaaucgagccaaaggcaacaggaccccgugggaagcguucggccgggacagggaaccgggcuuugacuggcccgaaaucgcagcacgcgcugcacggcuaccgaaaaauaagagcuggagguucgguccagacgccauggaaagacuggaaagagagggcgacuuucuggaccgccaacucaccgacacgcaauaccucucacgcauagcaagagaauacgucacaaaaaucugcgaccccaaccaaguguggguaacgccgggacgccuaacggcguggcuacgccgcaacuggggacucaacggcauucucccgaccggcaacgcgacuaaaaaccgggacgaccacagacaccacgcaauagacgcaauugucguaggccuaacagaccgaggaauccuaaacagaguaagccggagcgcggcacucgccgaagcagaagauuuagaccgaagcauagcggaaaugcccgaccccuucgacggcuuccgggacaacauccgacacauacuggaacaaauaaucguaucgcacaaacccgacgcaggauucguccccggacacccuaaaggaaacacaacaccaggugcacuccacaacgacacagcauacggcaucaucaaaacagacgcaaaaggcaugucagaaguagugacgcggaaggacguacucucguuuaagggcaccaaagagauagagagcauaagagacgcggcaacacgacaaagccuacuggacgccgucgccggcguuccaucaggacuggccuucaaagaagcgcuccgagauuggucgguccgaacugggacgaaacgaguccgagucacauucaacaugagugucaucccgauccaagacagagacggaaaagccuacaaaggauacaaaggagauggcaaccucugcgcagaaaucuacgaaaggcccgacggcaaauggggcgaugaaaucaucagccgauucgacgcaguccaaccaggcuucaccccacaauggcaaagagaccauccggccgcccacagagucaugcgacuauuccgcgacgacaugaucauggccgaaauagacggcguaaugaccgucugucgaauagucaaaaugucaccaggcaaagucgucuucacgccucaucacgaagcaaacacugacucacgaaaccgcgacaaagacgaccccuucuccuuccauaccugcucgggagaaucguuacgcaaaagaaaagcccaaaaacuauucguugacccucucggaaaaauacgagguuacagagcaaaggaaggauga

SEQ ID NO: 7272 - RNA, 3153 nt, Artificial Sequence
  Cas9 variant
augggagagaacaugauagacgagagccugacguucggcaucgaccuagguaucggaagcugcggaugggccguccuaagaaggcccagcgccuucggaagaaaggggguaauagaaggaaugggaagcuggugcuucgacguaccagaaacaagcaaggaacgcacgcccacgaaccaaauacgcagaucaaaccggcuccuucgcaggguaaucagaagacgccggaaccgcauggcagccauccgucgacucuuacaugcugccggauuacucccgaguacagacagcgacgcgcucaaaagaccaggacacgacccaugggaacuacgcgcccguggacuggacaagccccuaaaacccguagaguucgcaguuguacuaggacacaucgccaaacgccggggauucaaaagcgcagcgaaacgcaaagccaccaacauaagcagcgaugacaagaaaaugcugaccgcccuagaggcaacacgcgaacgccucggacgauaccgcacaguaggagaaauguuugccagagaucccgacuucgcaucccgaagacggaaucgagaagggaaauacgacaggacaacagcccgagacgaccucgaacacgaaguccacgcacuauucgcagcacaacggcgccucgggcaaggauucgccagccccgaacuagaagaagccuuuaccgccucggccuuucaccaacggccaaugcaagacagcgaacgccucgugggauucugccccuuugaacgcacagagaaaagagcggcgaaacuaacaccaucauucgaacgcuuccgccuacuagcgcgccuacucaacuugcgcauaacaacgccagauggagaaagaccacuaaccguagacgaaauagcacucgucacacgcgaccucggcaaaacagccaaacuaucaaucaaacgcguccggacacucauaggacuagaggacaaucaacgauucaccacaauccgcccggaagacgaggaccgagacauagucgcaagaacaggcggcgcaaugacagggaccgcaacccugcggaaagcccucggagaagccuuauggaccgacaugcaagaacgccccgaacaauuggacgcaauagugcagguacucucauucuuugaagcaaaugaaaccaucacagaaaagcuaagagagauaggccucacccucgccguccucgacguacugcuaaccgcccuagacgccgggguauucgcaaaguucaaaggcgcggcccacauaagcacgaaggcggcgagaaaccuccucccacaccuagaacagggacgaagguacgacgaagcauguaccauggccggcuacgaccacgcggccagccgacuaucacaccacggucaaauagucgcuaaaacacaauucaacgcccuaguaacggagaucggcgaaucaaucgcaaacccaaucgcaagaaaagcacucauagaaggacuuaaacaaauaugggcuaugcgcaaccacuggggccuuccaggaucgauacacguagaacucgcgagagacguaggaaacagcauagaaaaacgaagagaaaucgagaaacacaucgagaaaaacacggcccuccgcgcuagagaacgacgcgaaguacacgaccuacuggaccucgaagacgucaacggcgacacccuacuuagauacaggcuauggaaagaacagggaggcaaaugccuauauacaggcaaggcgauccacauucgacaaaucgcagcgaccgacaacagcguacagguagaccacauccucccauggagccguuuuggggacgacagcuucaacaacaaaacgcuaugucuagcuagcgcaaaccagcagaaaaagcgcaguacaccauacgaauggcuauccggacaaacaggggacgccuggaacgcauucgugcaacgaaucgaaacgaacaaagagcuaagaggauucaagaaacggaacuaccuccucaaaaacgccaaagaagccgaagaaaaauuccgaucaagaaaccuaaacgauacacgcuacgcagccagacuauucgccgaagcggucaaacuacuuuaugccuucggagaaagacaagagaaaggcggaaaccgccgcguauucacaagaccgggagcccugacagcggcccuacgccaagccuggggugucgaaucacuaaagaaacaagacggcaaacgcauaaacgacgaccgacaccacgcucuggacgcccucacagucgcggcaguagaugaagccgaaauucaacgccuaaccaaauccuuccaugaaugggagcaacaagggcuaggacgcccccugcggagagucgaaccuccgugggaauccuuccgcgccgacgucgaagcaacauacccagaaguguucgucgcacgcccagagcgcagacgggcccgcggcgaaggacacgccgccaccauccgacaggucaaagaaagagagugcacacccauaguauucgaaaggaaagcagucagcagccuaaaagaagccgacuuggaaagaauaaaagacggagaacgaaaugaagcuaucguagaagcaauaaggucauggaucgccacagggagaccggcagacgccccgcccagaucccccagaggcgacauuauaacgaaaauccgacucgcgaccacaauaaaagcugcaguacccguaaggggcggaaccgccgggcggggagagaugguucgagcagacgucuuuucgaaacccaaccggaggggcaaagacgaaugguaccuaguaccgguauacccgcaccaaauaaugaacagaaaagcauggcccaagccaccaaugcgcagcaucguagcaaacaaagacgaggacgaguggacagaaguaggaccagaacaccaauuuagguucucacuguacccccggucuaacaucgaaauaauacgaccaagcggcgaagucauagaaggauacuucguaggacuccaccgaaacaccggcgcccucaccauaagcgcccauaacgaccccaaaucaauccacaguggcauaggcaccaagacacuucuugccaucucaaaauaucaaguagaccgauucggccgaaaaagccccgugcgaaaagaaguaagaaccuggcacggagaggcaugcauauccccaacaccgccaggcuga

SEQ ID NO: 7273 - RNA, 3153 nt, Artificial Sequence
  Cas9 variant
augaagauacuuggcuucgacauagggauagcaagcaucggaugggcguucguugaaaacggugaacugaaagacugcggaguaagaauauucacgaaagcagaaaaccccaaaaccggugacucgcucgcaaugccucgacgagaagcacguucgguacgccgacggcuggcacgcagaaaaggccgccuagaaacccucaaacgacuccucgccaaagaaugggaccuaugcuacgaagacuacaucgccgccgacggcgagcuccccaaggccuucaugggcaaaaaccucaacaacccauacguccuacgcuacgaagcacuacaacgucuucucuccaaagaggagcuaguccgcgucgugcuccacaucgcaaaacaucggggguacggaaacaagaaugccaaaaucacgaaaagugaagaaucgaaacgggagcaagguaaaauacuauccgcgcucgcuacgaacgcauccgcaauagcaagguaccggaccgugggagaauauuucuacaaagaguucugugaagucaucaaaaacccacaagggcugagcacaaacgaacacuauacccaaagcaagguccggguccuaaaacccauacguaacaagggaggagaauacacgaacugcauccuucaggaggaccuccagcgcgagcuacgcugcauauucgaauaucagaaaggauucggcuuucccaucacccaggaauuucaggacaagauccucaagaucgccuucuaccaacgcccccucaaagacuucagccaccucgucggaaaaugcaccuucuaccccgaugaguucagggcucuaaaaugcagccuguccgcaguagaguucauaacccugagcaaaacaaucaacguccucacauacauauccaaagaaagcggggaaguauacuccaagggccaauacgaacaaaugcucgacucaguguucaaagcaguaugcgaaaagggcucccucagcuuugcccaacuacgcaagauacugcacauagacgaaagaauccgauuuaaggagguagacuacauggcccgaaagaguaaaaauacaucaggagacagcacccacaaacagaaaacgagcaacccugaaacuaagaaauucaucgaacacaaaaaccucaagaaauucugcgaaauccugagcgaaauagccgaggacagagcacucgccgacagcaucgcccgcgacaugacgcuaauuaaagacgaggaaaaacucgcucaaaaacuucacggauacggcaaauucucacaagagcagauaacccagcucagcgcccuuaacuucucacaccacaucaaccucucccuaaaagcccuuagcgagauacucccauucaugagagaaggcaugagauaugaugaagcaugcaaacuagccggacucaaggcaagacacaacgacaaaaagaguaaguuccuacccccauucugcgagucuauauacgccgacgaacugaccaaccccguaguacaccgagcaaucgcugaauaccgcaaaauacucaacgcacuaaucgccaaauacggauccguccacaaaauccacaucgagcuaacgcgcgacguuggcaaaaacuuccaagaacgcgaaaaguacaagaaagaaauagaguccaacuacaaagcgcgcguccaagccaugcaagagugcgaaaaacuaggacuaacgcucuccgaggggaacauccucaagcuaagacuuuuccgcgaacagaacgagaucugcguuuacagcggccgcaagauaacccuugccaaccucaaggaacaaggcgcccuugaaaucgaccacauacuccccuacucccgcagcuccgacgauagcuauaugaacaaaguacugguguucaccaacgagaaccaaaacaaaggaaacaaaaccccauaugaagcauucggaggagacucccagaaauggggagagaucgaaucccuagcacuacgcucaggcuacccuaaaaagaaagcgaaaaggauccucgacaaaggauucggcgaccgcgaagcaggauuuaaaagcagaaacauaguagacagcggcuacaucgcacgccugaucgccaacuacacaaaggaauaucuaaaguuccucccacuagacucccacgagaacaccgcacucauugccggcgaaaaagauagcaaaauccacguggaggccgucaagggaaugcuuaccgccaccaugagacauuucuggggacugggcagcaagaaccgauacgaacauacccaccacgccgucgaugcuaucauaauagccuacauaaaugcugcaaugauccagcgcuucucccaguuucggcaaaaccaagaaucccuaaaagcacgauucuacgcgaaagaacuagccaaagaagaguucaaaacccaacgcgcauucuucgaacccuuccggggcuucagagagcaaguccuagccaaaguuggacaaaucuucguaucccggcccccgcgaaagcgagcaagaggcgcccugcacgaggaaaccuucuacucuauagacgacaagaaacucucugaaacauacggcggcaaagaaggcguccagcgcgcccugucucucggaaaaauccgacaaaucgggacaaaaaucgucgccaacggcccuaugguccggguagacauauucaaacacaaacagagucgccgauucuacgccgucccgauauauacaauggacuucgcacuuggcauacuaccaaacaaagcagucgucagcggcaaagacaccaaaucgaaaguaaucaaggacuggcucgaaauggacuccugcuacgaguucugcuucucacuauuuaaagacgaccugaucgaaguccagaaaucagacauggagaaaccggagcuggccuacuucguaucccucgacgcaucggacggccggauaaagguucggcaccacugcaacgacaucacaaaaaucaacgaaaaccagaaaaagcuauucuccgaagccauagaaaaggaggucgucgggcguggcuccauccaaaaucugaaagucuucaaaaaguacaaggucagcccacuuggcgagaucaaagaagcaaaauaugaaccacgucaaccaauagcacucaaaaccagcccaaagaaacaccgaaaacaaaacaacgcccaauga

SEQ ID NO: 7274 - RNA, 3156 nt, Artificial Sequence; identical to SEQ ID NO: 1474
  Cas9 variant

SEQ ID NO: 7275 - RNA, 3159 nt, Artificial Sequence
  Cas9 variant
auggagaauaaaaaccugcacuacauccugggacuagaucucgggauagccucuguuggaugggcaguugucgaaaucgacgagaaagaaaacccgcuccgccucaucgacguaggcguacgcacauucgaacgcgcggagacccagaaaggagagagcuuggcccucucgaggcgcagcgcaagaagcgcacgcagacucacacagcgcagagucgcccggcucaagaaagcaaaaaggcuccucaaaagcgaaaacauccuccucuccaccgacgaacgccucccacaucagguauggcaacuacgaguggaaggacuagaccguaaacuggagcggcaggaaugggccgcaguccuacuacaccuaaucaagcaccgcggcuaccuuagccagcggaagaacgaaaguaaaucagaaaacaaggagcuaggcgcacugcucagcggagucgcaagcaaccacgaacuacuccagcaggcaaccuaucgaaccccugcagaacucgcaguaaagaaauucgaagucgaagaagggcacaucaggaaccagcaaggggccuacacacacacauucagcagacuggaccuccucgcggagauggagcuccucuucucccgccaacaacacuucggcaacccauuugcaagcgaaaaacuccucgaaaaccucacagcacuccucauguggcaaaaacccgcccuaucaggagaagauauacucaaaaugcuuggcaaaugcacauucgaggacgaauacaaggccgcaaagaacaccuacaccgccgaacgguucguauggaucacaaaacugaacaaucuccgcauacaagaaaacggacucgaacgcgcccuuucagacaaugagcgccuaaugcucauagaacaaccauacgaaaaggcaaagcuaacguacgcacaaguucgcagcaucuugaaccuaagcgacgacgccauauucaaaggagucagauacucaggagaggauaagaaagcaauagaaacaaaaacaacgcuaauggagaugaaagcauaccaccaaauccgcaaagugcuggaaggaaacaaccuaaaagccgaauggguagcccucaaggcaaauccaacccuacuagaugaaaucgggaccgcauucagccuauacaaaaccgacgaagauaucagcgccuaucuggccggaaagcucagccaaccaguacuaaacgcccucuuagagaaccugagcuucgacaaauucauccaacucucacuaaaagcccuauacaaacugcucccccuuaugcaacaaggacucagauaugacgaggcaugcagagaaauauauggugaccacuacggcaagaaaacugaagaaacccaucacuuccuaccccagaucccagcggacgaaauccgaaacccaguggucuugcgcacccucacccaggcacgcaaggucauaaacggcguaguccgccucuaugggagccccgcucgcauacacaucgagaccggaagagaggucgguaaaaguuacaaagaccggcacgaacugaaaaagagacaagaagaaaauagaaagcaacgagagaaaacaaucagcgaaaucaaaacacuauucccaaacuucagcggcgaacccaagggaaaagacauacucaaaaugagacuauacuaccaacaaaacgcaaaaugccuauacagcggcaaaccacuggaacuccaucgacuguucgaacaaaaauacguggaaguagaccaugcccucccacucagccgaaccugggacgacuccuucaacaacaaagugcucgugcucgccaacgaaaaccaaaacaaaggcaaccuaaccccguucgaauggcucgacggcaagaacaacucggaacgauggagaaccuucaaagcccuggucgaaacaagcgccuuccccuacgccaagaaacaacguauauuaagucaaaaacucgacgaaaaaggcuucaucgagcgcaaucucaacgacacacgcuacguagcccgauuccugugcaauuucaucgcugacaacaugcaucucacaggcgagggcaaaagaaaaguauucgccuccaacggccaaauuaccgcccuacuccgaagacguuggggacuagcuaaaagccgagaagauaacgacagacaccaugcgcucgacgcgguccugguggccugcagcacagucgcaaugcaacagaaaauaacacgcuucguucgguucaaagcgggcgaugucuucaccggcgaaagaauagaccgggaaacgggagaaauaauaccacuacacuuccccaccccauggcaauucuucaagcaagaggucgaaauacgaauauucuccgacaacccgaaacuagaacucgaaaaccgccugccagaucgcccccaagcgaaucaugaguucguacaaccccuguucguaucgcgaaugccgacaaggaaaaugaccggccaggggcacauggaaaccguaaaauccgccaaacggcuaaacgagggaaucagcaugaucaaaaugccacucaccaaacuuaagcucaaagaccuggaacuaaugguaaaucgcgaacgagaaaaagaccucuacgacgcauuaaaaacccggcuagaagccuucaaugacgaccccgcaaaagcauucgcugaaccauucaugaagaaaggcggagccaucgucaaaucaguacgugucgaacaaguacaaaagagcggcguacugguccgccaaggcaauggaguggcagauaacgccagcauggucagggucgacgucuuuaccaaggacgguaaauacuuccucgugccgauauacacauggcaagucgcaaagggaauacuaccgaacaaagccgucauacaaggaaaagacgaagaagacugggaagacauugacgacgccacauuccaguucucgcuacaccccaacgaccugauaagcguuaaaaccaagaaagacgaguuccuaggcuacuuuaacggacucaaccggcacacaggcggcaucaacaucagaacccacgaccuagagaaaagcaaagggaaacaaggaaucuucgaagguauuggagucaaaauagcacugucauucgaaaaauaccaaaucgacgagcuggguaaaaauauucgguugugcaaaccauccaaacgucaaccggugcgguga

SEQ ID NO: 7276 - RNA, 3159 nt, Artificial Sequence
  Cas9 variant
augaaaaacaccagucuaaacuauguccucgggcucgaccuaggcaucagcucaguagggugggccguugucgaaaucgaugaaaaagaaaacccacugucacuaauagacguuggaguacgaacauucgaacgcgccgaaacacaaaaaggagaaagccucgcccuugcccgccgacucgccaggucagcacgaagacugacacagcgcagaguggcccgguugaagaaagcaaaaagacuccuaaagagcgaaaacauccucuuaagcaccgacgagugccucccacaccaggucuggcaacuuagggucgaaggacuagaacgaaaacucgaacgccaagaaugggccgcaguacucuuacaccugaucaaacacagaggauaccuuagccaacggaaaaaugaaucaaaauccgagaacaaggaacugggcgcacuccuguccggcgucgccaauaaccacaaacuccuccaacaaaccaccuaccguacgcccgccgagcucgcggucaagaaauucgaaguagaagaaggucacaucaggaaccaacaaggguccuacacccacaccuucagccgccuggaccuccucuccgaaauggaacugcuauucucccgccaacaacacuucgggaacccguucaccagcgagaaacuccuagaaaaccuaacagcccuccuaauguggcaaaaacccgcgcuauccggagacgcaauacucaaaaugcugggcaaaugcacauucgaaaaugaauacaaagccgcaaaacauacauauagcgcagaacgguuuaucuggaucacaaaacuaaacaaccuacgcauccaagagaacggacucgaacgagcacucaaugacaacgaacgccuagcguuaaugaaacagcccuacgaaaaagcgaaacuaaccuacgcccaaguccgcuccauccuaaaccucuccgaugaagcaaucuucaagggacuaagauacagcggcgaggacaaaaagaccagcgaaacaaaaacaguucucauggagaugaaggcuuaccaccagauacgacucgcccuagagaaaaacgaucucaaaacugaaugggcagaacuaaaagugaacucgagucuccucgacgaaauaggaaccgccuucucccucuacaaaacagacgaagacaucucuaccugccuagcgggaaaacucagccagcccguacucaacgcccuacuggaaaaccucaacuucgacaaauucauccagcugucccucaaggccuuacacaaaauccucccgcugaugcagcaaggccuacguuaugacgaagcaugcgcagagaucuacggagaccacuauggaaagaagaccgaagaaaaccaccuccuccucccgcagaucccggccgacgaaaucaggaacccagucguacuccgaacacucacacaagcccggaagguaauaaacggcgucgugcggcuauacucgagcccugcgcggauacauauagaaaccggccgagaagucggcaagagcuaccaggaucgccgcgaauuagaaaagcgccaggaggaaaaccggaaacaacgggagaaagccauauccgagauaaagacccucuucccaaacuucuccggagagcccaaagccaaagauauccugaaaaugagacuauacuaccaacaaaacgccaagugccuguauagcgggaaaccccucgaacuacaccgacuacucgagcaaggauacguagaaauagaucacgcccuaccauucucucgaacaugggacgacagcuucaacaacaaaguacugguccuggccaacgagaaucagaauaaaggcaaccuaacaccauucgaauggcuagacgguaaaaacaacagcgagagauggaaggcauucaaggcccuaguggaaacgagcgcauuccccuacacgaagaaacaacgaauacuaucacagaaacuagacgaaaaaggcuucauagaacggaaccuaaacgacacacgcuacgucgcacgcuuccuuuguaacuucaucgcggacaacaugcaccucacaggugaaggcaaacgaaaagucuucgccagcaacggacagaucacagcccuacuccgaggcagauggggacuggccaaaaguagggaggauaacgaccgccaucacgcccucgacgcagucguaguagcuugcuccaccguaagcaugcagcagaaaaucacccgauucgugcgcuucgaagaaggcaacguauucacaggcgaacgaauagacagagaaaccggugaaauaaucccgcugcacuuuccugcacccuggaaguucuuccgagaagaaguggagauacggaucuuuuccgacaaccccaaacucgaacucgagaaccggcugauagcccggccucaagccaaccaugaguucguacaaccccuuuucgucagcagaaugcccacgcgaaaaaugacaggccaaggccacauggaaacaaucaagagcgccaaacgacuaaacgaaggccugucagucauaaaaauguugcucacgaaacuccggcuaaaggaccuagaguccaugguaaaccgggaacgagaaaaggaacuguacgaggccuuaaaagcacgccuagaagccuuuaacgacgagccagcuaaagccuucgccgaaccguucaugaagaaaggaggagccaucgugaaauccguccgagucgagcaaguccaaaaaucuggaguccuaguacgagacggaaacggcguagccgacaacgcaagcaugguacgggucgacgucuucacgaaagggggcaaauacuuccuagugcccauauacacguggcaagucgcaaagggcauacuccccaacaaagcaguaauccaaggcaagaacgaagaagacugggaagucauggacgaugccaccuuccgcuucagccuccaccaaaacgaccucgucaagcuagucaccaaaaagaaaacgauauucggauacuucaacggacuaaaccgagcaacaggaaacauugauaucaaagaacacgaccucgagaaaagcaaagugaaggacggcauacaucaguccauagggaucaagcuggcccucucuuucgaaaaauaccaggucgacgaacucggcaaaaacauccggcuaugcaaaagcagcaaacgccaagcaguacguuga

SEQ ID NO: 7277 - RNA, 3159 nt, Artificial Sequence
  Cas9 variant
augauuggcgagcacguaagaggcggcugccuauucgacgaccacuggacacccaauuggggagccuucaggcuccccaacaccguccgaacauuuacaaaagcugaaaaccccaaagauggcuccagccuagccgaaccaagacggcaggcacgcggccuccgccgcaggcuccggagaaaaacgcaacgacuagaggaccugagacgacuccuggcgaaagaaggcguccuuagccucagcgaccucgaaacccucuuccgagaaacacccgcaaaagauccguaccaacuccgcgcugagggccuagaccguccccuaucuuuccccgagugggugcgaguccucuaccacaucacaaaacauagaggcuuccagucuaaucgacgcaaccccguugaggacggacaagagcgcucaagacaagaggaagaagggaaacuccucucuggagucggcgaaaacgaacgacuacuaagggaagggggauaccgcaccgccggagagaugcuagcucgagacccaaaguuucaagaccaccgccgcaaccgcgccggggacuacucccacacccucucacgcaguuuacuacucgaagaggcccgacgacuauuccaaagccaaagaacccucgggaacccccacgcgagcagcaacuuagaagaagcauuccuacaccucgucgcauuccaaaaucccuucgccagcggagaagacaucagaaacaaagccggacacugcucccucgaaccggaccagaucagagcaccaagacgguccgcaucagcagaaacuuucaugcuucugcaaaagacaggcaaccuuaggcucauccaccggcgaacaggggaggaacgcccacucacggauaaagaacgagagcaaauccaccuacucgccuggaaacaagaaaaagugacacacaaaacccuaagacggcaccucgaaauacccgaagaaugguuauucaccggccuccccuaccacagaucaggcgacaaggcggaagagaagcuauucguacaccucgccgguauccacgaaauacguaaagcacuagacaaaggaccagaccccgccguaugggacacccugaggucaagacgcgaccugcuagacuccaucgcagacacccuaacauucuacaagaacgaggacgaaauccuccccagguuagaaucccucgggcuauccccagaaaacgcccgcgcccucgcaccccuaucguuuagcggcacugcacaucucagccugagcgcacuaggcaagcuacuaccccaccuggaagagggcaaaagcuacacacaagcacgagccgacgcaggguacgccgccccgccaccagaccgacaucccaaacuaccgccccuagaagaggcagacuggcguaauccaguaguguuccgcgcccucacccaaacccggaaagucgugaacgcccuuguccgccgauacggaccacccuggugcauacaucucgaaacugccagagaacucagccaacccgccaaagugcggcgaaggaucgagacagagcaacaagcaaacgaaaagaaaaagcaacaggcagaacgagaguuccuagacauaguaggcaccgcccccggaccaggcgaccugcucaaaaugcgacucuggagagaacaaggcggcuucugccccuacugcgaagaauaccugaacccaacccgccuagcagaaccaggcuacgccgaaauggaccacauccucccauauuccagaucacucgacaacgguuggcauaacagaguccuuguacacggcaaggacaaccgcgacaaagggaaucggacccccuucgaagcauucggaggcgacaccgcgcgcugggacagauuagucgcauggguacaggcgucucaccucucggcccccaagaaacgaaaccuacuuagagaagauuucggagaggaagcagagcgagaacuaaaggacagaaaccugacagacacgagauucauaacaaaaacugccgcgacccuacucagggacagacugacauuccaccccgaagcaccaaaagacccaguaaugacgcuaaacggccgccucaccgccuuccuacguaaacaauggggucuccacaaaaaccgaaagaacggcgaucuacaccacgcucuagacgcagcaguucucgcugucgcgucacggagcuuuguauaccgacucuccucgcauaacgccgcauggggagaacucccccgaggaagggaggcagaaaacggcuucucacuccccuacccagcauuccggagcgaaguacuagcacgacucugccccacgcgggaagaaauacuacuacgacuggaccaagggggaguaggcuacgaugaggcauuccgaaauggccugcgccccguauucguaucccgagccccaucacgacggcuucgaggcaaagcacacauggaaaccuuacggucccccaaauggaaggaccacccagagggaccccgcaccgccuccagaaucccacuaaaagaucugaaccuggaaaaacuugaacgcaugguagggaaggaccgcgaccgaaagcuauacgaagcccuaagagaacgauuagccgccuucggcggcaaugggaaaaaggcauucgucgcuccauuccguaaaccauguagaagcggagaaggcccacucgucagaagccuccggauauucgauagcggcuacagcggagucgaacuaagagacggcggagaagucuacgcggucgcagaucacgaaagcauggugcgaguggacgucuacgcaaagaaaaacagauucuaccuagucccugucuacgucgcagacguagcucgcggaaucguuaaaaaccgugcaauaguagcacacaaaagcgaagaagaaugggaccuaguagaugggagcuucgacuucagauucagccuauucccaggagaccucguggaaaucgaaaagaaagauggggccuaucuaggauacuacaaaucgugucaccgcggggauggcagacuauuacucgacagacacgaccgaaugccccgagaaagcgacugugguacauucuacguaagcacaagaaaagacguacugagcauguccaaauaucaaguagauccccugggggaaauccgccuagugggcucagaaaagccgcccuucguccuauga

SEQ ID NO: 7278 - RNA, 3162 nt, Artificial Sequence; identical to SEQ ID NO: 1382
  Cas9 variant

SEQ ID NO: 7279 - RNA, 3162 nt, Artificial Sequence; identical to SEQ ID NO: 1479
  Cas9 variant

SEQ ID NO: 7280 - RNA, 3162 nt, Artificial Sequence
  Cas9 variant
augaagcgcaacuacauccugggccucgacaucggaaucaccagcgugggcuacgggaucaucgacuacgagacccgggacgucaucgacgccggcgugcgccuguucaaggaggccaacguggagaacaacgaggggcggcgcuccaagcggggcgcgggccgccugaagcggcgccggcgccaccggcuccagcgcgucaagaagcugcuguucgacuacaaccuccugacggaccacuccgagcuguccgggaucaaccccuacgaggcccgggugaagggccucucgcagaaacuguccgaggaggaguucagcgccgcccugcuccaccuggccaagcgccgcggggugcacaacgucaacgagguggaggaggacaccgggaacgaguuauccaccaaggagcagaucagccggaacuccaaggcgcucgaggagaaguacguggccgagcugcagcuggagcggcucaagaccgacggggagguucgcggcagcauuaaccgguucaagacguccgacuacgugaaggaggccaagcagcugcugaaggugcagaaggaguaccaccagcucgaccagagcuucaucgacaccuacaucgaccuacuggagacccgcagaaccuacuacgagggcccgggggagggcucccccuucggguggaaggacaucaaggagugguacgagaugcucaugggccacugcacguacuuccccgaggagcugcgcagcgucaaguacgccuacaacgcggaccuguacaacgcccucaacgaccucaacaaccuggugaucgccagggacgagaacgagaagcucgaguacuacgagaaguuccagaucaucgagaacguauucaagcagaaaaagaagcccacccugaagcagaucgagaaggagauccuggucaacgaggaggacaucaagggcuaucgggugaccuccaccggcaagccggaguucagcaaccucaagguguaucacgacaucaaggacaucacggcccgcaaggagaucaucgagaacgccgagcugcuggaccagaucgcggaaauccucaccaucuaccaguccagcgaggacauccaggaggagcuggucaagcugaacuccgagcucacccaggaggagaucgagcagaucagcaaccugaagggcuacaccgggacgcacaaccugagccucaaggccaucaaccugauccuggacgagcucuggcacaccaacgauaaccagauggccaucuucaaccggcugaagcuggugcccaagaagguggaccucucccagcagaaggagauccccaccacccuggucgacgacuucauccucagccccguggugaagcgcuccuucauccagucaaucaaggucaucaacgccaucaucaagaaguacggccugccgaacgacaucaucaucgagcucgcccgggaaaagaacuccaaggacgcgcagaagaugaucaacgagaugcagaagcgcaaccggcagacgaacgagcgcaucgaggagaucauccggaccaccgggaaggagaacgccaaauaccugaucgagaagaucaagcugcacgauaugcaggagggcaagugccucuacagccuggaggccaucccccuggaggacuugcugaauaaccccuucaauuacgagguugaccacaucaucccccgcuccgucagcuucgacaacuccuucaacaacaaagugcuggugaagcaggaggagaacagcaagaagggcaaccggaccccguuccaguaccucuccagcuccgacagcaagaucuccuacgagacguucaagaagcacauccugaaccuggccaaggggaagggacgcaucagcaagaccaagaaggaguaccuucuggaggagcgggacaucaaccgcuucuccguccagaaggacuucaucaaccggaaccugguggacacccgcuacgccacccgggagcucaugaaccugcugcgcagcuacuuccgggugaacaaccucgacgucaaggugaaguccaucaacgggggcuucacguccuuccugcgccgcaaguggaaguucaagaaggagcggaacaaaggguacaagcaccacgcggaggacgcccugaucaucgccaacgccgacuucaucuucaaggaguggaagaagcucgacaaggccaagaaggugauggagaaccagaccgucgaggagaagcaggcggagagcauguccgagaucgagacagagcaggaguacaaggaaaucuucaucacgccccaccagauccagcacaucaaggacuucaaggacuacaaguacagccaccgcguagacaagaagcccaaccgggagcugaucaacgacacccuguacagcacccgcaaagacgacaaaggcaacacccucaucgugaacaaccugaacggccuguaccacaaggacaacgacaagcuaaagaagcugaugaacaagagccccgagaagcugcucauguaccaccacgacccgcagaccuaccaaaagcugaagcugaucauggagcaauacggggacgagaagaacccccuuuacaaguacuacgaagagacgggcaacuaccugaccaaguacuccaagaaggacaacgggcccgucaucaagaagaucaaguacuacggcaauaagcugaacgcccaccucgacaucaccgacgacuaccccaacagccggaacaagguggugaagcugucccugaagccguaccgcuuugacgucuaucucgacaacgguguguacaaguucgugaccgucaagaaccugaacguaaucaagaaggagaacuacuaugaggugaacucaaagugcuacgagaaggccaagaagcugaagaagaucuccgaccaggccgaguucaucgcgagcuucuacaacaaugaccucaucaagaucgacggggagcuguaccgggucaucggcgugaacaccgaccugaucaaccgcaucgagguaaacauggucgacaucacguaucgggaguaccucgagaacaugaacgauaagcgaagcccccggaucuucaagaccaucgccuccaagacccagaguaucaagaaguacagcaccgacauccuggggacgcuguacgaggugaacuccaagaagcacccccagaugaucaugaagggcuga

SEQ ID NO: 7281 - RNA, 3162 nt, Artificial Sequence
  Cas9 variant
augaguggcaugguguucgggauagaccuaggcauagccagcugcgggugggccguacucaggcaaccgcaaagagacggcgauccaggagagauaguagaccugggcaguuggauguucgaugugccggaaacagacaaagaaaggacgccaacaaaccaggucagaagggggaacagacuccucagacgcguaaucagaaggagagcacaaagaaugguggaaauaaggcgcuuauuccacgaccauggguugcuggcaggccacgcuccagaagcacuaaagagagcagggcuggauccgugggaucuuagggcaaggagccuagacaagguauuggaaccagcggcacuggcaguagcacugggccacauagcaaaaagacgcggcuucaagagcgccgcgagaaggaaagaagcuaacacggcaggggacgaccagaaaauguuaaaagcauuggaagcgacucacgagaggcuggggcgauacaggacgauaggagagauguucgcacgcgauccagacuuugaaagcagaaagaggaauagagauggcauguucgacagaacacagggcagagacgaccuacugcaugaggugggcgaaauauucaaagcacagagaagacuaggaagugcgcuggcaacggcagagcuagaacaagccuucacggcaaucgcauucaggcaacuaccaauacaagacagugaaaggcuagucggacugugccaauuugaaccaaaggagaagagagccgcgcgguucgcgcccagcuucgagcgauucagauuacuucaaaggcucacgaaccucagagugguaacgguugagggugaacgaccacuaacagccgacgaaauagcagcggcagcggccgaccugggcagaacggcaaaacucucgguaaaggagguaaggaaacgcauaggucuagcagcagaccaccgcuucgccgcauucaaagccgaugaagaggacagggacauaaucgcgcggacaggagaggcgcugcacgggacguaccgacuacgcaaggcacuaggcgaaggacuaugggccgaaauguuaccaggccaguuggacgcaauagcacacgcgcugagcuucuucgagacccaggacguuauacugaaagaacucgauaaacuagaccuaccggccggaguaagagacgcaauagcaacaggauuagacgcgggggcauucgcaagauucaagggaacgggccacauaagcgcgagagccgccagggcguugcuuccgcaccucgaagccggauugagauacgaccaagcguguacaaaagcaggguaugaccacgcggcaucgaggugggcaaaaagggagcaaguagcggacaaagccgcauucaaccgccuaguaacggacaugggggccgagaucgccaauccgaucgcacggaagagucuuacugaagcucugaagcaacuaugggccaugaggaacagguggggucugccggacgccauacacauagagcucgcgcgcgacgugggcaauagccuggagaaaagaagggaaauugaaagggcgauagaaaagaacaccgcggcgagagaacgcgaaagaggagaagcaagggaccugcucggaauagacgacguaagcggggacacacuucuacgauacaggcuguggaaagaacaggcagggagaugucccuacacagacgcaccgauaccgcccggagcgaucaucgcgaccgauaacucauuccagguagaccacaucuuacccuggagcagguucggggacgacagcuucgccaacaaaguacuaugcgcaacggcagcaaaucaaagaaagaaagggcagacacccugcgaauggauaacagcggcccagggagaggaaggaugggcaacauucgucgccaggauagaaggaaacgccgcguuccgaggcccgaagaaacgaaacuacguacuuaaaaacgcaaaagaagccgaagagagguuccgagccagaaaccugaacgacacaagauacgcagcgagacugcuagcagaagcagugaaacuauucuacccugaaggagaaagacaggacaaaggaggagugagacgaguguucacacgaccgggcggccugacugcggcacucaggcacgcguggggaguagaagcgcugaagaaaagagacggcaaacggguggacgacgcacgccaucacgcccuagacgcccuagucguagcggcaauaggcgaaggggaaguacagagacuaacgaggagcuaccaagaaugggaacagcaagggcucgcaagaccgcuacgaagggucgaucccccguggggagacuuccauuccuucaggagagagguaaaggacgcguacgacggcauauucguagcaagaccggaaaggcgacgagcaagaggggagggacacgccgccacgauaaggcaaguaagagagcgggacggcgcugcuguagucuucgaacggaaagcaaucgcggaccuaagcgaaaagcggcuagcagacaucaaagauccagaacgaaaccaggcgauuguagaggcaaucaggcaauggauaguagacggccgacccgccgaccgacuacccaggagcccggcgggagacgagauuaggaaagucagauuacgaacaaaaggcaaaccggcaguacaggugcgaggaggggcagcagaccgaggggaaaucgugagaguagauguguuuacaaaaccgaacaagaaagggaaaaacgaguuuuaccuaguaccaaucuacccgcaccaaguaaugaacaaggcggaguggccaaccccacccaugagagcagugguagcuuacaaggacgaauccgaauggacccuacuagaugaaaacuucggauuccuguucagccucuucccacggucguacgucgaggucacaaagccgggaggcgagguauugagcggcuacuuccaagggauggacagaagcacgggagcaaucagccuauuuaaccaccgugacagccgaucgcuaacagaugacagcgggaauagcacccggggaauaggagcgaaaacccuacugacaaugaagaaguacagcgucgacagguuuggaaagagggcagaggucaagagugaaguaagaacauggcacgggguggccugcacauacccaacgcccccgggguga

SEQ ID NO: 7282 - RNA, 3165 nt, Artificial Sequence
  Cas9 variant
augaaacuaacaccccugaacuacauccuaggccuagaccucggcauagccuccgucggcugggcggucgucgaaaucgaugaacaagaaaacccccuaggauuaauagaugucgguguacgcaccuucgaccgcgcagaggucgcaaagaccggcgagagccuggcgcuagccaggcgacucgccaggagcucccgccgacucguaaaaagacgagcagaccgcaucaagaaaguaaaaagacuacugaaauccgaaaacauccuacuauccgcagacgaacaacuucccaacgacgucuggcaacuuagaguaaaaggacuagaccaaaaauuagaaagacaagagugggccgccguccugcuccaccuccucaagcaccggggauauuuaucccaaagaaagaacgaguccaagucugaaaacaaggaacuaggggcccuuagaagcggaguggccgcaaaucaccaaauacuacaauccgccgaguacagaaccccggcggaaaucgccguaaagaaauuucacgucgaagaagggcacauccggaaucaacggggcgccuacacacacaccuucagccgccuagaccuccuagcggaaauagaacuacuauuuacgcgacagaccgaacuuggcaacccucacacaagcgccaaauuacuagaaaaccugaccgcacuacuaauguggcaaaagccagcacucgcuggcgaagcaauccucaaaaugcugggcaaaugcaccuucgaaccuaccgaguacaaagccgccaagaacuccuacuccgcagaacgcuucgucuggcuaaccaaacuuaacaaccuacgcauccuagaacaaggcgcagaaagggcgcuaacagacaacgaaagauucgcucuacuagaccaaccuuacgaaaaagcaaaauucaccuacgcccaagcacgaacaaugcucgcccuacccgacgaagccaucuucaaaggcguccgcuaccaaggagaagacaagaaagcuguagaaacaaaaaccauccucauggaaaugaaagccuaccaccagauaaggaaagcccucgagaacgcggaccuaaaagccgaauggaacgaacucaaaaacaacagcgaacuacuagacgacauaggaacagccuucucccuacacaaaacugacgaggacaucugccgcuacuuggacggcaaacuaucagaaucaauacucaacgcacuacucgaaaacuuaaauuucgacaaauucauccagcucucccuaaaagcacuacagcaaauacucccgcuuaugcuccaagggcagcgauaugacgaagcaguaagcgcaaucuacggcgaucauuacggaaagaaaagcgccgaaaucaaccgccuacuccccaccauacccgcagacgagauccguaacccgguaguacugcggacauuaacccaagcccguaaagugauuaacgcggugguaaggcuauacggcuccccagcccgcauccacaucgaaacaggaagagaagucggcaaauccuaccaagacagaaagaaacuggagaaacaacaagaggacaaccguaaacaccgcgaaagcgcgguccaaaaauucaaagaauacuuucccaacuuuguaggugaaccaaagggcaaagacauccucaaaaugaggcucuacgaacuccaacaggcaaagugccucuacuccggaaaaagccuagaacuccaccggcuucuagagaaaggauacguagaaguagaccacgcucuaccauucucgcggaccugggacgacuccuucaacaacaaaguacugguccucgcuaacgaaaaccaaaacaaagggaaccuaacuccauaugaguggcuggacgggaaaaacaauucagaaccauggcagaacuucguagcacgaguacaaacaucuggcuucagccacacaaagaaacagcgcauccuuucucacaagcuagacgaaaaaggcuucaucgaaaggaacuuaaacgacacacgcuacgugguacgauuccugugcaauuucaucgcagauaacaugcuccuaaccgguaaaggaaaacgcaaagucuucgccagcaacggacagauaacagcccuccuacgaggccgcuggggccuccaaaaggugcgcgacgacaacgaccgacaucacgcacuagacgccgucgucgucgccugcaguaccguagcuaugcaacagaaaaucacccgcuucguacgcuaugaagaaggaaacguauucucaggggagcgcaucgaucgcgaaacuggcgaaauaaucccucuccacuucccgucgccaugggcauucuuucgcgaaaacguagaaauccgaaucuucucagaaaaccccaaacucgaacuagaaaaccggcuaccagacuacccgcaauacaaccacgaguucguccagccacuguucgucucgcguaugccaacccgaaaaaugaccggccaaggacacauggaaacagucaaaagcgccaagagacucgacgaaggacucuccguccucaaagugccccugacucagcucaaacugaacgaccucgaacgcauggucaaccgcgaacgcgaaauggcccucuacgaaagucuaaagguaagacucgagcaauucgacaacgaccccgcaaaagccuucgcagaacccuuuuauaagaaaggcggcgcacuggugaaagccguccgcgucgaacaaacccagaaaagcggcguccucguccgagauggaaacggaguagccgacaacgccagcaugguucgagucgacgucuucaccaaagccggcaaauacuuucucgucccaauauacaccuggcaaguugcaaaagggauacuccccaauaaagcuguaacggccaauguugacgaaauagacuggcuugaaauggaugaaagcuaccaauucauauucacuauguauccaaacgacuuaguaaaagucaaacugaaaaaggaagaguucuucggcuacuacggagggcuagaccgcgcaacuggcgccauagucaucaaagaacacgaccucgaaaaauccaagggccgccaagggauauaccgcauuggagugaaacucgcccucucauucgaaaaguaccaaguagacgaacuagggaaaaacauaaggcccugccgaccaacaaagcgacaacacguacgauga

SEQ ID NO: 7283 - RNA, 3165 nt, Artificial Sequence; identical to SEQ ID NO: 1483
  Cas9 variant

SEQ ID NO: 7284 - RNA, 3165 nt, Artificial Sequence
  Cas9 variant
augaaccagaaguucauccugggccucgacaucgggaucaccagcgugggcuacgggcugaucgacuacgaaaccaagaacaucaucgacgccggcguccgccuguuccccgaggccaacguugagaacaacgaggggcggcgcuccaagcggggcagccgccggcucaagcgccggcgcauccaccggcuggagcgcgugaagaagcugcucgaggacuacaaccugcuggaccagucccagaucccgcagucgacgaaccccuacgcgauccgggucaagggccucuccgaggcccugagcaaggacgagcuggugaucgccuuacugcacaucgccaagcgccgggggauccacaagauugacgugauagacuccaacgaugacgucggcaacgagcugagcaccaaggagcagcuaaacaagaacuccaagcugcugaaggacaaguucgugugccagauccagcucgagcgcaugaacgaggggcaggucagaggcgagaagaaccgcuucaagaccgccgacaucaucaaggaaaucauccaguugcugaacgugcagaagaacuuccaccagcucgacgagaacuucaucaacaaguacaucgagcugguggagaugcggcgcgaguacuucgagggacccggcaagggcagccccuacgggugggagggcgacccgaaggcgugguacgagacccugauggggcacugcacguauuuccccgacgagcuccgguccgugaaguacgcuuacagcgccgaccuguucaacgcccugaacgaccucaacaaccucgucauccagcgcgacggccuguccaagcucgaguaccacgagaaguaccacaucaucgagaacguguucaagcagaagaagaaacccacccugaagcagaucgcuaacgagaucaacgugaaccccgaggacaucaagggcuaucggaucaccaagagcgggaagccgcaguucaccgaguucaagcuguaccacgaccucaagagcguccuguucgaccagagcauccuggagaacgaggacguacucgaucaaaucgccgaaauccugacgaucuaccaggacaaggacuccauaaagagcaagcugaccgagcucgacauccugcugaacgaggaggacaaggagaacaucgcccagcucaccggcuacaccgggacgcaccgccugucccugaagugcauccgccucgugcuggaggaacagugguacagcagccggaaccagauggagaucuucacccaccugaacaucaagcccaaaaagaucaaccucaccgccgccaacaagauccccaaggcgaugaucgacgaguucauccugucccccgucgugaagcgcaccuucggccaggccaucaaccugaucaacaagaucauugagaaguacggggugccggaggacaucaucaucgagcuggcccgggagaacaacagcaaggacaagcagaaguucaucaacgagaugcagaagaagaacgagaacacgcgcaagcggaucaacgagauaaucggcaaguacggcaaccagaacgccaagcgccucgucgagaagauccggcugcacgacgagcaggaggggaagugccuguacucccucgagagcaucccccuggaggaccugcucaacaaccccaaccacuacgagguugaccacaucaucccccgcuccgugagcuucgacaacuccuaccacaacaagguccuggugaagcagagcgagaacuccaagaaguccaaccugacccccuaccaguacuucaauagcggcaagagcaagcucuccuacaaccaguucaagcagcacauccugaaccugagcaagucccaggaccggaucagcaagaagaagaaggaguaccuccuggaggaacgcgacaucaacaaguuugagguccagaaggaguucaucaaccggaaccugguggacacccgcuacgccacccgggagcucacgaacuaccugaaggcguacuucuccgccaacaacaugaacgugaaggucaagaccaucaacgggagcuucaccgacuaccugcgcaagguguggaaguucaagaaggagcggaaccacggcuacaagcaccacgccgaggacgcccucaucaucgccaacgcggacuuccuguucaaggagaacaagaagcugaaggccgugaacuccguccucgagaagcccgaaaucgagagcaagcagcuggacauccagguggacagcgaggacaauuacagcgagauguucaucauccccaagcagguccaggacaucaaagacuuccgcaacuucaaguacagccaccggguggacaagaagcccaaccgccagcugaucaacgacacccucuacuccacgcggaagaaggauaacagcaccuacaucgugcagaccaucaaggacaucuacgccaaggacaacaccacgcugaagaagcaauucgacaaguccccggagaaguuccugauguaccagcacgacccccgcaccuucgagaagcucgaggugaucaugaagcaguacgccaacgagaagaacccccuggccaaguaccacgaggagaccggggaguaccuuaccaaguacagcaagaagaacaacggccccaucgucaagucccucaaguacaucggcaacaagcuggggagccaccuggaugucacgcaccaguucaaguccagcaccaagaagcucgucaagcuguccauuaaaccguaccgguucgacgucuaccugaccgacaaaggcuacaaguucaucaccaucagcuaccucgacgugcugaagaaagacaacuacuacuacauccccgagcagaaguacgacaagcugaagcucgggaaggcgaucgacaagaacgccaaauucaucgccuccuucuacaagaacgaccugaucaaacuggacggcgagaucuacaagaucaucggggugaacagcgacacgcggaacaugaucgagcuagaccugcccgacauccgcuacaaggaguacugcgagcugaacaacaucaagggcgagccccggaucaagaaaaccaucggcaagaaggucaacuccaucgagaagcucacuaccgacgugcuggggaacguguucaccaacacgcaauacaccaagccgcagcuccuguucaagcgcggcaacuga

SEQ ID NO: 7285 - RNA, 3165 nt, Artificial Sequence
  Cas9 variant
augaaguuaacaccccucaacuauauacuaggccuagaucugggaauagccagugucgggugggcaguuguagagauagacgaacaggaaaacccccucggccuaaucgacgucggaguacgcacguucgacagagccgagguacccaagaccggcgaauccuuagcccucgcacgucgacucgcccgcuccgcccgccgccuggugaagcggagggccgacagaaucaaaaaggccaaacgucuccuaaaagccgaaaacauacuccuaucggcagacgaacaccuacccaacgacgucuggcaacucagaguaaagggccuagaccaaaaacucgaacgacaagaaugggccgcaguccucuuacaucugcuaaaacaccgaggcuaccuuucgcaacgcaaaaacgaauccaaaucagaaaacaaagaacuuggagcacugcuaagcgguguggaaacuaaccaccagauccuccaauccgccgaauaccgaacacccgccgaaaucgccgucaagaaauuccacgucgaagacggacacauaaggaaccagcgcggcgccuacacccacaccuucucacgguuagaccuccucgccgaaauggaacugcuauuccaaagacagaccgaccucggcaacccccacacaagcgcaaagcuacucgaaaaccucacagcgcuccucauguggcaaaaaccggcacuggccggcgaagccauacuaaaaaugcucggaaaaugcaccuucgagcccaccgaauacaaggcagcgaagaacagcuacagcgcagaacgauucgucuggcuaaccaaacucaacaaccuccgaauccuggaacagggagcagaacgcgcgcuuacagacaacgaacgguuugcccuccuggaccaaccguacgaaaaagccaaauucaccuacgcacaagcccgcaccaugcuagcccuccccgacgaggccauauucaaagggguacgauaccaaggcgaggacaagaaagccgucgaaacgaaaacaauccuaauggaaaugaaagcauaccaccaaauucguaaagcacucgaaaacgcggaccuaaaagcagaauggaaugagcucaaaaacaacucugaacuacuagacgacauagggacagccuucucacuacacaaaaccgacgaagacaucugccgauaccuggacggaaaacuaucagagucuauucugaaugcacuccuugagaaccuaaacuucgauaaauucauacagcuuagccucaaagcccuccaacaaauauugccccuaaugcuccaaggucaacgauaugacgaagcagucuccgccaucuauggcgaccacuacggcaaaaagucggcggagaucaaccggcuacugccaacgauccccgcagacgaaauccguaauccggucguacuacggacacucacacaggcacgaaaggugaucaaugcggucguccgacucuacggcuccccggcccgaauacacaucgaaacaggcagagaagucggcaaaucuuaccaagaccgcaagaaacucgagaaacaacaggaagauaaccgcaaacaacgcgaauccgccgucaagaaauucaaagaauacuuuccgaacuucguaggggaaccaaaagggaaagacauacuaaagaugcggcucuacgagcuacaacaggcaaaaugucucuacuccggcaaaucacuagaacuacaccgacugcuugaaaaaggcuacgucgaaguagaccaugccuuaccauucucccgaacaugggacgacucauucaacaacaaaguccuaguccuggccaaugagaaccaaaacaaaggaaaccucacgccauaugaauggcuggacggcaaaaacaacagcgaacacuggcaaaacuucgucgcuagaguccaaacuuccggcuucucacacaccaagaaacaaagaauacucucccacaagcucgacgagaaaggguucaucgagcgcaaccuaaacgacacccgcuacgucgcacgguuccuauguaacuucauugcagacaacaugcucuuaaccggcaagggcaaacgcaaggucuucgccucaaacggccaaaucaccgcacuucuacgagggcgcuggggccuccaaaaaguacgcgacgacaacgaccgacaccacgcacuagacgcuguagucgucgcgugcucaaccgucguaaugcaacaaaagauaacgagauucguaagauacgaggaaggcaacguauucagcggcgaaagaaucgaccgagagacaggcgagauaaucccccuucacuucccaucaccgugggcguucuuucgggaaaacgucgaaauacguauauucuccgagaaccccaagcuggaacucgaaaaccgacuaccagauuacccccaguauaaccacgaguucguacaaccccuuuucguaucacgaaugccaacccggaaaaugacuggccaaggccacauggaaaccguaaaaagcgccaaacgccucgaugaaggacucagcgugcucaagguaccacuaacgcaacucaagcugucagaccuugagagaaugguaaaccgcgaacgugaagucacccucuacgagucacucaaagcccgacuagaacaauucggcaacgacccagccaaagcguuugcugaaccguuccacaagaaagguggcgccguggucaaagcagucagagucgagcaaacacagaaaaguggggucuuaguacgcgacggcaacggcguagcagauaacgccuccaugguccgaguagauguauucacaaagggcggaaaauacuuucuugucccgauauacaccuggcaaguggcgaaaggcauccuccccaacaaggcgguuacggccaacgucgacgaaaucgacuggcucgagauggacgaaucauaccaauucaucuucaccauguacccuaacgaccugguuaaggugaagcucaagaaagaagaguucuucggcuacuacggagggcuagacagggccaccggggcuauuguaaucaaagaacacgaccuggagaaaagcaaagggaaacaggguauuuacagaauaggaguaaaacuagcccuauccuucgaaaaauaccaaguagacgaacucgguaagaacauccgccccugccggccaacaaaacgacaacacguccgcuga

SEQ ID NO: 7286 - RNA, 3165 nt, Artificial Sequence; identical to SEQ ID NO: 1486
  Cas9 variant

SEQ ID NO: 7287 - RNA, 3165 nt, Artificial Sequence
  Cas9 variant
auggaaaacaagaaccucaauuacauccuuggccucgaccucggcauagcaagcguaggcugggccguaguagaaaucgacgagaaggagaacccccuaagacuaaucgacgugggcguccgaacauucgaacgagccgaaguuccgaaaacuggcgagagccuugcgcugucccgacgacuagcaagaagcgcgagaaggcucacacaacgacgcgucgcacgccuaaagaaagccaagcgucuccuaaaguccgaaaacauacugcuaucaaccgaugaaagacugccccaccaggucuggcaacuacgagucgaaggacucgaucacaaacucgaacgacaagaaugggccgcuguccuacuccaccuuauuaaacaccgaggauaccucucccagcgcaaaaacgagagcaagagcgagaacaaagaacuaggcgcacuccuaagcggaguagacaacaaucacaaauuacuacaacaagcaaccuaccgaagcccugccgagcucgcaguaaagaaauucgaaguggaagaaggccauauccgaaaccagcagggggcguacacccacaccuucagccgacucgaccuacuggcagaaauggaacuucucuucucacgucaacagcacuucgggaacccauucgcaagugagaaacuacucgaaaaccugacagcccucuuaauguggcaaaaaccugcccucuccggcgaagcgauccuaaaaaugcuaggcaaaugcaccuucgaagacgaguacaaagccgcaaagaacacauacagcgcagaacgcuucguguggauaacaaaacucaauaacuugagaauccaagaaaacggacucgaacgcgcgcucaacgacaacgaacgccuugcacuuauggagcaaccauacgacaaaaaccgccuauucuauucccagguccgaagcauccugaaacuaucggaugaagcaaucuucaaagggcucagguacucuggggaggacaagaaagccauagagacaaaagcaguacuaauggaaaugaaggcuuaccaccaaauacgcaaaguacuagaaggaaacaaccucaaagccgaaugggccgagcuuaaagcaaacccaacccugcucgacgaaauuggcaccgccuucagccuauacaaaaccgacgaagacauauccgcauaccucgcugggaaacuuucccagccaguccucaacgcgcuacuagagaaccucagcuucgacaaauucauacaguuaucccugaaggcccucuauaagcugcuaccacucaugcaacaaggacuccgguacgaugaagccugccgcgaaaucuacggagaccauuacggcaagaaaaccgaggagaaccaccacuuccucccacagaucccggcagacgaaaucagaaacccaguaguauugcggacguuaacccaagcacguaaagugaucaacgggguagugcgccuguacggcuccccagcucgcauccacauagagacaggccgugagguuggaaaaagcuacaaagacagacgagaacucgaaaagcgucaagaagaaaaccggaagcaacgggaaaaugccauuaaggaguucaaagaauauuuuccccacuucgccggcgaaccuaaagcaaaggacauacucaaaaugcgcuuauacaaacaacagaacgcaaaaugccuauacagcggaaagcccaucgaacuccauagauugcucgagaagggauacgucgaaguggaccacgcccuccccuuuagccggaccugggacgacagcuucaacaacaaaguacucguacucgcaaacgaaaaccaaaacaaagggaaucucacaccuuucgaguggcuagacggaaaacacaauagcgagagguggcgagcauucaaagcccuagucgaaacgagcgcauuccccuacgcaaagaaacaacgcauucucagucagaaacuugacgaaaaaggcuucauugaacgaaaccuaaacgacacccgguacgucgcucgcuuucucugcaacuucauagcagacaauaugcaccucacaggcgagggcaaacgaaaaguauucgcaucgaacggccaaauaaccgcucuccucagaagccgauggggccuggccaagucacgagaagacaacgaccgacaccacgcgcucgacgccgucgucgucgccugcagcaccguagcgaugcaacagaaaauuacgcgcuucgugcgauucgaagccggggacguauucacaggagaacgaauagaccgcgaaaccggagagaucauaccacuccacuuccccacacccuggcaauucuucaaacaagaagucgaaauacgcaucuucuccgacaaccccaaacuagaacucgagaaccgacuaccagacagaccacaagccaaccacgaauuuguacaaccacucuucgucuccagaaugccgacccgaaaaaugaccggccaaggacacauggagacugucaaaagcgcaaaacgccucaacgaaggaaucagcguaauuaaaaugccgcucaccaagcugaaacucaaagaccucgaacugaugguaaaccgcgaaagagaaaaagaccucuacgacacacugaaagcaagacucgaagcguuuaaugacgacccagcgaaagccuucgcagaaccguuuauaaagaaagguggggcuauagucaaaagcguccgcgucgaacaaauccaaaagucaggaguacucguacgcgaggggaacggcgucgccgacaacgccagcaugguccgagucgacguuuucacaaaaggaggcaaguacuuccuaguucccaucuacaccuggcaaguagcaaaaggaauacugcccaacaaggccgcaacccaguacaaagacgaagaagacugggaggucauggacaacuccgccaccuuuaaauucagccuccacccaaacgaucucguaaagcucgugacgaaaaagaaaaccauacucggcuacuucaacggacucaaucgcgcaaccggaaacauagauauaaaagaacacgaccucgacaaauccaaaggaaaacaaggcauauucgaaggaguagguaucaaacuagcacugagcuucgagaaauaccaaguagacgaacuaggaaagaacaucagacuaugcaaaccaucaaagcgacaacccguacgguga

SEQ ID NO: 7288 - RNA, 3168 nt, Artificial Sequence
  Cas9 variant
augaacaacuacauccugggccuagacaucgggaucaccagcgugggcuacgguaucgucgacuccgacacccgcgagaucaaggacgccggcgugcggcuguuucccgaggccaacguagacaacaacgagggcaggcggucuaagcgcggcgcccggcgccugaagcggcgccggauccaccgccucgaccgggucaagcaucuccuggccgaguauaaccugcuggacuuaacgaacaucccgaaguccaccaaccccuaccagauccgcgugaagggccucaacgagaagcugucaaaggacgagcuggugaucgcccuccugcacaucgcgaagcggcgcgggauccacaacguuaacgugaugauggacgacaacgacuccggcaacgagcugagcaccaaggaccagcucaagaagaacgccaaggcgcuguccgacaaguacgugugcgagcugcagcucgagagguucgagcaggacuacaagguccgcggagagaagaaccgauucaagaccgaggacuuuguccgcgaggcccggaagcugcuggagacacagagcaaguucuucgagaucgaccagaccuucaucaugcgcuacaucgaccucguggagaccagacgcgaguacuucgaaggccccgggaagggcucgccuuucggcugggaggggaacaucaagaagugguucgaacagaugaugggccacugcaccuacuucccggaggagcugcgcagcgucaaguacgccuacuccgccgagcuguucaacgcgcucaacgaccugaacaaccuugugaucacgcgggacgaggaggccaagcucaacuauggggagaaauuccagaucauagagaacguguucaaacagaagaagacccccaaccugaaacagaucgccaaggagaucggcgucagcgagaccgacaucaagggcuaccgcgugaacaaguccgggaagcccgaguucacccaguucaagcuguaccacgaccucaagaacaucuucgaggacagcaaguaccugaacgacgugcagcugauggacaacaucgccgagaucaucacgaucuaccaggaccccgaguccaucaucaaggagcucaaccugcugccggagcuccugagcgagaaggagaaagagaagaucuccgcccugagcggauacgcggggacccacagacucucccugaagugcaucaaccugcuccuggacgaccugugggaaagcucucucaaccagauggagcuguucaccaagcugaaccucaagcccaagaagaucgaccugucccagcagcacaagauccccaucaaauuagucgacgacuucauccuaagccccguggugaagcgcgccuucauccaguccauucaagucgugaacgccaucaucgacaaguacggccucccggaggacaucaucaucgagcuggcucgggagaacaacucagacgaccgccggaaguuccugaaccagcuccagaagcagaacgcagagacccgcaagcaggucgagaaggugcugcgggaguacgggaaugacaacgcgaaacgcaucguucagaagaucaagcugcacaacaugcaggagggcaagugccucuacucgcugaaggacaucccccucgaggaccuccugaagaaccccaaccacuaugaggucgaccacauaaucccccgaagcguggccuucgacaacuccaugcauaacaaggugcugguccgcgccgaggagaacagcaagaagggcaaccggacgccguaccaguaccucaacuccagcgaguccagccugagcuauaacgaguuuaagcagcacauccugaaucucagcaagaccaaggaccgcaucaccaagaagaaacgggaguaccugcuggaggagcgcgacaucaacaaguacgacgugcagaaggaguucaucaaccggaaccucguggacacccgcuacgccacgagagaacugaccucccugcucaaggccuacuucagcgcgaacaaccuggacgucaaggugaagaccaucaacggguccuucaccaacuaccugcgcaagguguggaaguucgacaaggaccgcaacaagggcuacaagcaccacgccgaggacgcccucaucaucgccaacgccgacuuccuguucaagcacaacaagaaacugcggaauaucaacaagguccucgacgcgcccagcaaggagaucgacaagaagcgcgugacggugcaguccgaagacgaguacaaccagauguucgaggacacccagaaggcccaggccaucaagaaguucgagauccggaaguucagccaccgcgucgacaagaagcccaaucggcagcugaucaaggacacccuguacagcaccagaaacaucgacggcaucgaguacgugguggaguccauaaaggacaucuacagcgucaacaacgacaaggugaagacgaaguucaagaaggacccccaccggcuccugauguaccgcaacgacccgcagaccuucgagaaguucgagaagguguucaagcaguacgaguccgagaagaaccccuuugccaaguacuaugaggagaccggcgagaagauccggaaguucagcaagaccgggcaaggccccuacaucaacaagaucaaguaccugcgcgagcggcuuggccgccacugcgacgucacgaacaaguacaucaacucccgcaacaagaucgugcagcugaagaucuacagcuaccgcuucgacaucuaccaguacgggaacaacuacaagaugaucacuauauccuacaucgaccuggagcagaaguccaacuacuacuacaucagccgggagaaguacgagcagaagaagaaggacaagcagaucgacgacagcuauaaguucaucggcuccuucuacaagaacgacaucaucaacuacaacggggagauguaccgcgugaucggcgucaacgacagcgaaaagaacaagauccagcuagacaugaucgacaucuccaucaaggacuacauggagcugaacaacaucaagaagaccggggugaucuacaagaccaucggcaagagcacgacccacauugaaaaguacaccaccgacauccugggcaaccucuacaaggcggcgcccccgaagaagccccagcugaucuucaagcgggggauggaguga

SEQ ID NO: 7289 - RNA, 3168 nt, Artificial Sequence
  Cas9 variant
augacaccuauaagugagucccugcuauucggacucgacgucgguauaagcagcugcggaugggcgguccugaaacacagcgacaccacuggacacauugaagcacuaggaagcuggugcuucaacgcacccgaaaccaagaccgagcgcacccccacaaaccaaauccguaggagcaguagacuacuacggaggguggucagacggagacgaaacagaaugaccgagauacgccgacuauucgccagacacggacuaauagacaacgaccggccugacgcccugcggcagcccgccauagaccccugggaaaugagaggccaggggcucgaccgacaacuaacaccggaggaguucgccguugcccuugcgcauauagccaaacaccgcggguucaagagcucugccaaacgugugaaaagcaacgccaguccugacgauucgaaaauguuggcggcccucgaaaagacaaaagaacuauccgcgcaauaucgcaccaucggcgagauguucgcccgagacagcgcguacguacaacgcagacgcaacagagacggccuguucgaccgaacgauuagcagagacgaucugauagacgaggccaaaauccuuuucgaccgccaacgcaaacugggcaaccccgucgcaagcacagagaucgaagaagcauucacacgaaucgccuucuggcaaaacccaaugcaagacagcggaguccuaguagcgucaugccccuuugaacccaaggaaaaacgcagcucacgguuuuccccgucguucgaacgcuuucgccugcucugcaggcugaucaaccugcgagucaccgacggacccgaggaacgcccacucacagaagaagaacugcgacucgcauacgagcacgccgggaaaacaagaaaauugaccgcagcagcaauacgaaaacucauagggcuccgcgacgaccaacacuucacaaccaucccgccagaacaggaaaaacaggacauaaccagccgcaccggcgaaaccuucgccgguacugcaacauucaggagcguauuaggagaaucucucuggcgccaacuccucccgcaccccgaauggcucgacaacgcagcguggaucauaucguuccacgagcuaacggaaaccaucaucaagaaacuaggagaaaucggucuccccguagaggcauacgaauuaaucugcgacgcgcucaaaucagacaaaucaccauucgccaaauucaaaggggccagcucccuauccgacaaagcuguucgagcacuaaucccguaccuacagcaaggccugacauacgacaaagcaugccaaaaggccggauacgaucacgccgcaagcagguucagcgggcgggcaaccaucgacacaaaggcaaaguucaacgcacugauggcggaaguacgagacagcaucgccaauccaauagcacgaaaagcccucagcgaaggaaugaaacaacuaugggccaugagaaaccgcuggggacuccccggcgcgauauguaucgaacuagcccgcgacguaggcaacucccucgaaaaacgaaaagagauagaacggaaccuaaaaacaaccgccaagcaaagagcccgggagcgcgaagaagcaugcgagcuccuuaaccucaaagaaguaagcagcgacauacucuugcgcuaccgccuauggaaagaacagggcggccgauguugcuacagcggaaaaaguaucacacccgacaugcuaauggcacaagacaaccgaauacagaucgaccacauucugccauggucaagguucggcgacgacucauacucaaacaaaggccucugcuuggccaaggaaaaccaagcuaagaaaaaccaaacgccguacgaauggauccacggccaggguacaaccgcccaaaaagaacaaugggacaaguucguagccgacgucgaaucacggaaaaauacaaagggccugaagaaaagaaacuuucuacucaaaggauccaaagagauagaggaacgcuucagaagccgaaaccuaaacgacacacgauacgcagcacggcucaugguagaagccgcuagacuacucuacccagcagggcaaagaggcgaaaaaggcggcaccagaagaguguucacgcgcccaggagcacucacugccgcgcuccgacacgcauggggagucgaaagucucaagaaaaucgacggcgagagacuacacgauaaucgacaccaugcacuugacgccgccaucguggcugcaguuagcgaggcggagauacaaaaacuaacaaaaucauuccaagaaugcgagcagaaaggacuaucacgcccaaugagagacgucgccccaccgugggacggauucagagaccaacucaaagagaaauacgaaacaaucuucguagcacgcccggaacgccagcgggcacgaggacagggccacgaggccacaauacgccaagucagagaggaagaaaccggaccagucauauacgaacgaaaagcaguaagcgcccuaacacucgcggaccuugcgaaaaucaaagaccccgacagaaacgcaggcuuaauagcgagucuucgccaauggauugaagccggcaaaccagccgacaagccgcccagaacaccaugccaccaaagcgcagcaggacacgagauccgcaaaguccgauuggccacaaucaucacaccggcaguccccgucagaggaggcauggcaaaaagaggagaaaugacacgagucgacauauucaaaguaaucggaaagaaaggaaagccagaaugguacaugaucccaaucuacccccaccaaaucaugaacaggagccaauggccagcgcccccaaacaaagcagucguagcggguaaaagcgaggcggacuggccgauuaugggggccgaagcacaauuucaauuuucgcuauacccuugcagcuacguccggcuauucaaagaaggaaccgucauagagggcuacuuuugcggcugccacagaagccgggcauacaucacacuagcccugagcacuggcgcggcuccccuacaaaagggaauagguaucaagacccaagaacacauacaaaaguucagcguaaaccgguuuggcgaacucagcccugucaaacaagaaacccgcacauggcauggaguagccugcaccagccccgaccaacacgacuga

SEQ ID NO: 7290 - RNA, 3171 nt, Artificial Sequence
  Cas9 variant
augaaagcccucaacuacauccucggacuugaucucggaauugcgagcgucgggugggcagucgucgaaaucgaccaaaacgagcuuccgauacgacucaucgaccucggaguaagaaccuucgaacgcgcagaagucccgaaaaccggcgacucccucgcccuagcccggagacuagcccgaaguagcagacgacucguaaggaggagagccguccgccuccuaaaagccaagagacuacuaaaacaagaaggaauccuacaagccgaugacuuucacagcagccaccucaagccacuacccaacaaccccugggaacucagaguuaaaggacuaaaccaccuacucgacagaaaggaaugggccgcaguacugcugcaucucuuaaaacaucgcggauaccuuagccagcggaaaaacgaaagcaaaacggacaacaaagagcucggcgcacuacugaaaggaguaagcgaaaaccgacaacugcuacaggcacaggccuucagcacacccgcggagauagcgauaaagaaauuccaacaggaagagggccacauacgcaaccaacguggugccuacagccacaccuucgaccgaaaugaccuccuggccgaacuuaggcugcuauuccaaaaacaaagagaguucaacaacccauacaccagccaaagccucgagcaagcaauagcggaacuccugauguggcaaaaaccugcacuuucaggagaagccauccuaaagaugcugggcaaaugcacauucgaacccucggaauacaaagcccccaaaaacucauacucagcagaauacuucgucuggcugacaaaacuaaacaaccuccgaauacuagaaaacggugccgaucgaggccucacagcagaagaaagacagcuucuaauaaaccagccauuugagaaagcaaaguucaccuacgcccaggcacguaagcuacuagaacugagugauuuagcgauuuucaaggggguccgauacggaaaggacaacgccgaaagcgccacgcucauggaaaugaaggcuuggcacgccaucaggaaagcccuagaaagcaacggauugaaaaccgaauggaauggccuuaaaacgaagcccgaacugcuagacaaaaucggaaccgccuuuagcauauacaaaacagaugaagacaucagccaguaucucaauggcgaacuuucccccgcaguacuaaacgcccuccuagaaaaccucuccuucgacaaguuuaucagacugagccuccaaagccuagcuaaaauacucccgcuaauggaacaagggcuacgauacgacgaagccugcaagcaagucuacggggaccacuacggcaagaaagaacagcuagaacuacgguuccuaccaaaaauacccgucgaggacauccgcaacccggucgugcuucggacccugucacaagccaggaaaguaaucaacggcgucguacggcuauacggcucaccagccaggauacauauagaaacaggacgcgaagucggaaagagcuuuuccgagcgaagagacaucagcaaacgccaggaagaaaaccgaaacgaaagacagcgcgcagucgaaaaauuuaaggaguucuucccgcacuucgugggagaacccaaagccaaagacauucuaaagaugcgacuguacgaacaacaacauggcaagugccuguacucaggcaaagaacuggaccuaaaccgacugcuugaaaaaggauacguggaaaucgaccacgcucugcccuucucccgcaccugggacgacagcuuuaacaacaaaguccuaguccuagccucggaaaaucaaaacaaggguaaccagaccccauaugaauggcugaauggcaaggagaacgccgaacgauggaaacuauuccaagcauuaguaaacggaagcagauucccauacucaaagaaacaacgaauccuaaccaaauaccucgacgaagacggcuuucgggagcgcaaccuuaacgacacacgcuacgucgcccguuuccugugcaacuucauagaagacaauaugcaacuugugggccaaggcaagaaacgggucuucgcaagcaacgggcaaauuacagcgcuccucagacgauccugggggauccaaaaaguacgagaggacaacgacagacaccacgccgucgaugccgucguaguagcaugcagcacacgggcccuucagaaaaagaucaccgacuacguacgcuacaaggagaugaacguuuucaccggagagaaaauagaccaagaaacaggcgagaucauaaaauuccacuuccccgaaccauggaaauucuuccgucaagaagucgaaauacgaguauucagcgagaccccugccgaagacgucguaaucgcgcucccagaccggccccaagccaaccacgaguucauacaaccccuguucgucagccgggcccccacacgaaagaugaccggacaagggcacauggaaacuaucaaguccgccaaaagacuagccgaaggccucagcguaucccgcgucccgcugacacaacuaaaacucaaagaccucgaaaacauggugaaccgagaacgcgaaaaagcacuauacgaagcccuaaaaguccgacuagaaaaguucaacaacgaccccgcgaaagccuucgccgacccauucuacaagaaaggcggacaacaagucaaagcaguacgcguagaacaaguacagaaaagcgggguacuuguccgacaagaaaacggggucgccgacaacgccagcaugguccgagucgacgucuucauaaaaggaggcaaauacuuccucguccccauauacacauggcaaguagcaaaaggaauacucccaaaccgcgcagcaacacaaggcaaagaagaggaguacugggacauaauggacgaaaccgccaucuuccaguucucacuuuaccaaaacgaccucauaaagcucgucaccaaaaagaaaacaaucuucggcuauuucaacggccugaaucgcgcaaccagcaauauaaacaucaaagaacacgaccucgacaaaagcaagggcaaagacggcaucuacuuagaagucgggguaaagcucgcacucucacuagaaaaauaccagguggacgaauuaggcaaaaauauacaaccaugccgcucgaugaagaaacgaccacccguccgcuga

SEQ ID NO: 7291 - RNA, 3171 nt, Artificial Sequence
  Cas9 variant
augccaaaacagaaaagcacccgauauagacucgcacuagaccucggaagcacaagccuaggcugggcagugcuccgccugaacgagcaacacgaaccgaaugccaucauacgagccggagucagaaucuucagcaacggcagaaaccccaaagacggaucaucccucgcgguaacacgacgggcagcucgggccaugcgcagacgccgagaccgccuccugaagagaaaagcgagaaugaugaacaaacuggucgaauacggauucuucccagcagacguagccgaacggaagaaauuagagcggaucaacccauacgaacuacgggccaaaggacuugacgccccgcugaccccuggcgaguucgccagagcccuauuccacaucaaucaaaggcgaggguucaaaagcaaccgaaaaaccgauaagaaagagaacgacucgggagcacugaaagcagccaucagccaccuacgacaacaauuacaugaacgcaaagccagaaccgucggugaguggcuauggcagcgccuccaagcaggacuaggaacacgagcgagauaccgggaguccagagucgcccaagcaaacggaaaaacgcgaaucgaaaagagcuacgaucuguacgucgacagacaaaugauagcagaagaguuugacgcccucugggcggcccaggccgccuucaacccccaacaauucuccgaacaggcgcguggagaacuaagagacguacuacucuuucaaagagaccugcgaccggugagaccgggacgcugcacucuccuccccgacgaggaaagggcuccacucgcccuccccagcgugcagagauucagaauauugcaagaagcaaaccaccuacgccuccuacacccagaccuacgggaggagcccuugagccuagcacaacgcgacgcaguaguagacgcacucgaacacaacucgaaacgaaccuuugaacaacuaaggaaacuacuaaagcucaacggcacagucaaauucaaucucgaggaugagaaaagaaaggaacucaaagggaacgcgacaagcgcgacacugagcaaagacggucucuucggagaaaacugguggaaccucgacgaagccuuacaagacgcaaucguguggcagcuaguaagcgaacaaucagaagaaaaacuccaaaacuggcuacaagccaacacaggcgucaaugcgacacaagcagaaacaauagccaacgccggccucccggagggauacggcagccucagcuacaaagcgcucgcacguauaauccccgcgcucagagggacagaagucgcaaacgggaucgacgucccgcgcacauacgaccaagcagugcaagcagcgggauucgcccaccacagcgaccuagacagcggauucgacuuugaacacagccacgaugaaguagaacgaauaggagaacgagugauagcaagcacaggagaaguaaaacccgucuuugcuuucaaacagcuaccauacuacggaaaagcgcucagaaggcacguagcauucgccaaagaacacccccgcaacgaagaagaacgguacgggaagaucgcaaacccaacaguacacaucgggcuaaaucagcuacgaguggucguaaacgcguuaauucggagauacggcaggccaaccgaaguaguagucgaauuggcacgcgaucucaaacaaucgcgggagcagaggcaagaagaacaaaaacggcaagcagacuaccaaaaacgcaacgaacacauucggcgcgaaaucgcauccaugcacggcugcgcggaagaacgaguaagccacgccgacguccaaaaauggauauuaugggaggaacugagcuuugacguagcagaccgucgaugccccuacuccggugugcagaucagcgcccaaaugcuacucagcaaccaaguggagauagaacacauucucccauuuagucaaacacuagacaacagcuugaacaaccgaaccguagccaugagacaagcaaacagaauaaaaggaaacagaaccccauggcaagcacgagaagacuuugaaaggcaaggcuggucauacgauucaauacugcaacgagccgaaagaaugccaaaagcgaaacgauaccgauuuucaagagacggauacgaaagauggcuaaaggaggacaaagacuucuuagcaagagcgcuaaacgacacccgguaccuaucacgaguagccaaaacauacauggaacugguaugcccgcuaggcaccagagucauaccggggcagaugacagcacuccuaagggcaaaguucggucugaacgacgugcucggacuaaauggcgagaaaaacagagaugaccacaggcaccacgcgguggacgccugcgugauaggaguaacagaccaaggccugcuacagagguucgcccaagccagcgcagacgccaggggaaauggacuggaaaaacugguagaaaacaugccagugccaugggccaccuaccgagaccacguaaaacgcgcaauacagugcaucuggguuucgcacaaaccagaucacgguuacgaaggcccaaugauggaagagaccgcguauggaauccggaaagacggaagcauaagacagaaaaccaaggcagacgguucaacggggcgcgagauaacccaccuuaucagaauaacggagccaacccagaacuugcgacacggugucgacgcccaaggacaaccccuagcauacaaaggcuacguagggggaaguaacgacugcauagaaaucacgcaaaacgagcaaggcaaaugggaggggaacgucaucaccacauuccaagcauacgauauaguccgcaggcucggcaguaagcaagggccccggagacucagacacccaacacucgcgcaaacccuagacguauacggaaaacccaaaaagcuaguaaugagauuaaugaucgacgacugcguccgccuggagcuggacgggaacaagaaaacccuccgcgucguaaaaauaacuggaaacggacagguauucauggccccaguucacgaagcgaacguagacaaacgaaacagcgacaaaacggaucccuucgcguacguaagcaaauaugccggcucauuccagaaagccaaagcacgcagaauaacaaucucaccgaucggcgagcugcaugauccgggcuucuga

SEQ ID NO: 7292 - RNA, 3174 nt, Artificial Sequence
  Cas9 variant
augagcgacaaguccaagauucugggcuucgacaucgggaucaccagcaucggcugggccuacguggagggugaggagcucaucgacugcggcguccgcaucuucacgaaggccgagaaccccaagacgaaggagucccuggcgcugccgcggcgcgaggcccgcggugugcggcggcgccucgcccggcgcaagggccgguuaaacgccaucaagcagcugaucugcaaggaguuuggccugaacuaccaagacuacaucgcucaggacggggagcugccaaaggcguacgcgggcaagcugaucaaccccuacgaguuacgcagcaaggcucugagagagaaguuggagaaggaggagcucgcccgcgugauacugcacaucgcgaagcaccggggguacggcaacaaacacgccaaggagaccgacgacgccgaguccgggaagaucaagaaggccaucucaaacaacgaaaagauccugaacgagaagggcuaccaguccgccggcgaguaccucuaccaggaguucuuccagaaggagcgacugcaggaggagaagaaggggaacaacaccaccaaagaguucaagaacgugcggaacaaggcaggcgacuacgagcacugcaucgcccagacucagaugcagaaugaacugcgucucaucuucgagaagcagcgggaguucgggcugaacuucagcgaggaguucaagaagaagguguuagagaccgccuucuuucagcgcccccucaaggacuucucggacaagaucggcgacugcaccuuuaucgagggcgccaagagagccccgaaggacagccuguccgcgaucgaguucguggcccuggggcgaaucaucaacacgcucaagaaccugcagaacacgucuggcgaggucuacucacgggacaagaucaacgagauccugcagaucguucucgacaagggggagaucagcuauaagaagcugcgugagauccuggacaucgaguccagcgugcgcuucaaggacuccaaacuggacuacaccaaagagcugaaggaggccgagaagacuaagcuguuugagagcaagaacuuacagaaguucaagaaggcccuaggcuccuucgaggggaucagcagggagauccuggacagcaucgccaaggagauuaugaucaccaaggauaaggagaagcucgcgaaggagcugaagaaguucccccuggacgagacgcagauccagaaccucuccaaccugagcuucucccagaccaucaaucugucccucgaggcccugucccagauccugcccuucaugcgcggcgagcgggaggacaagugccuccgcuaugacgaggccgucgagaaggccggccugaaggagguggccaagaacaagagcaaggacgacuuccugcccccgcucgagaacuaugagcccuaccuggcgaaucccguggucgcccgggcacugagugaguaccgcaagguguugaacgccuuacugagaaaguacggcaagaugcacaagauccacauagaguucaccagagaaguggguaagagcaaggaggagcggaacaagaucgagaaggagcagaaggagaacuucgcgaagaaccaggaggcccagaagcagugcgagaucuuggggcuccccaucaacggcgccaacauccugaagaugaaacuguggcgcgagcagcaggaguccugcgucuacagcgggaaggagaucgccauugaugaccucaagaauccggccauccuccagguggaccacauauaccccuacucacggagcuucgacgacuccuacaacaacaaggucuuggucuucagcaaggaaaaucagaacaagcugaacaagacccccuucgaggcguucggcgagaacaaggacaagugggagaagauccugucccuggccaguaagcucccaaagcccaagcgccagcggaucuauaacaugcaauucaaggacaaggagcagggcuucuuaacgcgcaacauaaacgacaccggguacaucgcccggcuggugucccaguggaccaagaauugccucagcuucgaaaagcuguccgaggacgaggugagcaucgcuggcgagaaggggagcaagguccacguggaggugaucuccggcucacugaccgccaugcuccgccacuacugggggcugggcgacaagaaccgggacaaccaccuccaccacgcggucgacgccaucauuaucgccuacuccaaugagaagguaaucaaggccuucagcgauuacaagaagcaccgcgagcagaacaaggccaaguucuacgcgaaggagauugccgaguccgaguacaaaaagcagaaggucuucuucgagcccacgaaccacuuucggcagaaggugcuggagaagauagacagcaucuucgucaguaagccgccccgcaagcgcgcccgaggcgcucugcacgaagagaccuucuauagcuucgagcgcuuaugcaacgacaaggaguacgcgaagaaggagaagauggacuacggaggcaaggccgggauccagaaggccaucgcccucggcaagauccggcaggucggcaccaagauugugaguaacgguacaauggucagggucgacaucuuccagcacaaaagcaacggcaaguucuacggggugcccaucuacaccauggacuucgcccugggcgugcugcccaauaaagcggucguguccggaaaggacaagcagggagugauuaaggacuggcucgagauggacagcaacuacgaguucugcuucucccuguucaaggacgaccugauccucgugcagaagaaggagauggagaaggccgagcugugcuacuacaccgacuucaacagcaacaccgccggcaucaaguucgagaagcacaacaaccuguacgugaaccucaacgaaaacgagcggaagcuguuuaccuccaaggagguggucaagggugggaagaagaacguguggaaggacaagacgcccaaggagaucgagcagcuggagaagaaccggaaaaucaucgggggcuuugugaccaucgaagaccugaagaccuucgagaaguaccagguaaguccccugggggaggugcagaaggccgacuucgcgccccggcaggccaucacccugaaguccagccccaagcaccgcaucaacaaguga

SEQ ID NO: 7293 - RNA, 3174 nt, Artificial Sequence
  Cas9 variant
augaguaaccgagugcccuaucgcuuggcauuagaccucggaacaaacucgauaggguggugccuauuggacuugaacgggaacggagaccccugcggggucagaagaaugggaguaagaaucuuccccgacggacgagauccgaaaagcaaagaaagccuagcagcagaccgcagacucgcaagaagcaugagacgaagacgggaccgguaccuacggagacgguccgcgcuaaugaacgcgcuagucgccgcgggacuaaugccggccgaucgcgccaccagaaaagcgcuagaaagcgaggacccuugcgagcuaagagcuagagcccuauuugaaccucugaccgcgggccaggugggcagggcacucuuucacuuaaaccaacgccggggauucaaaagcaacaggaaggcagcaggggaagaaaacgaggcaggcaagaucaaggcaggcauaagugcgcuaaaggcagagauagaggccagcggagaaacaacacucggagcauggcucgcagcacgacaccggaagagggaaaccgucagagcuagacuagacggagccggugcaaaggcaagcuacgaauuuuauccagaacggggacugguacacgacgaguuccaagcaauacgaacagcacaggcgcuacaccaccccgcgguaacggcagagcaaugggacagggucgagagcgugauauuuagacagcgaccacucaggcccgugcgcccgggaaagugcacccuguucccagaccaggagcgagcuccaugggcccugccaguagcucaggaguuccgaauccuaacagaaauagggaaccuaaagcucuaccgaccgggagaagaaccgcgagaacuguccgcggaccaacacgcacagcuuuucgcaaagcuaugccgaagcgccgaucucacguucgaaaagauaaggaaggaacuaaaacucgauccaggcuuaaaggugaacuuggaaggagaaaagagagacaggcuaaaaggcgacgcggucacaagcgcgcuauccgcaaagaagagguucgguccaaaguggaacgcauuaaccccagacgaucgacgugacaucgucggaagacuaauagaggccgaggacgaagccgagcucgcaggaugguuagagagcguccacggacucccaagcgagaacgcagcacauacggcggccucgcccggccuaccagacggauacugccgauugagugaaaaagcgcuagugaaauugguaccccugaugcgagaacaacgccucagguacgacgaagcgguacuagcacucaacuugcaccacagcgauuucaggccugaaggguuacucgaugagcugccauacuacggggaaccccuggaaagguucauagccuucggaagcggagaaccgagcgacccgccagaacaacaccuaggaagauucccgaauccgacaguacacaucggucuaaacgaacuacggaaguuaguaaaccggauagucgaacgauggggcaaaccggcagacaucguaguggaacuggcgcgggaucuaaaaaggucacgggacgagagagacacuauacaaagagaacaggcccaaaaccaacgcaaaaacgaggaccgauuugcgaaaauaaaagaguuaggaaucgacccgaggccggauagcaugcuaagacuuaggcugugggaagaacuccccaaagugggcguaggccacgucuguguauacacaggagaacccauaggaaucaggagacuucucgaaggggacgucgauauugaucacauccucccauucucgagaacccucucggacggagcugacaauaaaauagugugcguaagacgagccaacagguucaaaagagaccgcagccccugggaagcauuugggguaacagcggucgacggguacgacugggcagcgaucgcgcagagggcagaggaacuacccaagaacaagcgauggcgauuccucccagacgccauggaccgauucgaaggagaaaggggauuccucgacaggcagcuaguagaaacgaggcaucuaucaagaguggcccgacaauaccuagcgagcauaguggaccugaacaagguacgcguggcccccggcaagcucacagcgaugcuaagggcaagauggggacucaauaaaauacugagcgacggaaaucucaaaaacagaagcgaccauagacaucacgcgauagacgcagcgguccugggaaugauagaccaaagacucguacaauugguagcacaggcagcagcgcgggcggaggcaaacgaacucgaaaggcuguucgacgggcugccagacccuuuugacgggcuagcggccacgagcuucggugaccaagucagagagaaaauuagggggauaacaguaagucaccgagcugaacacggauggcagggccggaugcauaaugacaccgcguacggaccaguagaagcagucaacggaguucacaccguaguuacccgaaaaccacuuucaggacucacagcgaaggauuuccccaauaucagagacagaguacuggcuaaggcacucgaagaccacguagcagcagaggccgccgcaggacgaucauucggggacgcacuaggcagcuuuaaauggggaggccaaccaguuagacgugugagaaugcuagacguauuaggcaacccaauacccauacaagaucccagcggaacggucuucaaaguguacaagggcgacucuaacgcaugguacgaaauauuaagggauccaaggggaagauggacaggcaagaucgugaguacauucgaagcauaccgauuacacagagagugguuagccgaaacgggcggagauagugguaggggaucgggcguguuccuggauugggccgccaaaaggguaguaggcgaagccgggacgccgcuauucaggcuguuuaaaggcgaucuacuagcccuaggugaagcaccagacagacgcaucguaagagucgugaaauucagcgaaggucaaguagcacuugcacugcaucucgaagcagggaaccuaaaagcgagagaugcggacaaaggcgacccauucaaguaccaauacugcagcccagacaguuuaaggaagcaggcagccaggcccgcaggggucgaccuauugggcuauguccaugauaaaggaccguuagaauga

SEQ ID NO: 7294 - RNA, 3174 nt, Artificial Sequence
  Cas9 variant
augcgaagacucgggcuggacauaggaaccaacuccauaggcuggugcuuaauagaggacgacaagaaaauagucgacauagguguacgcaucuucagcgacgggagggacccaaaaaguggggcuucacucgcagucgaccgacgagacgcccgcgcgaugaggcgcagacgagaccguuaccucggccgccggucagcauuccuacaagcucucguaguacacggccuaaugccagccgacgccgacgaagcgaagcuagucgcagaccgcgaucccuaccagcucagagcaaaagcccuccacgucgcacucgaaccguucgaaauaggcagagcccuguuccaccugaaccaacgcagaggauucaaauccaacagaaaagccgaccgaaaagccaacgccggcgaagauggcaaaauagcagaaggcgcaaaagcacucgaccaagccaugagcgaagcaggcguagacacacuaggacaguuccucgcacuuaaagaaacgaaaagagucaggcucgggagcgauggacaagcguacgacuucuacccacagcggcgacacauagaguacgaguucgaccgcauauggaaaguacaaagcgaauaccacccggcacucuugaccgaagccgcccgcgccgcgcuucacaggauacuauucuuccaacgaccacugaaagcgcaagaagugggcuucugcaccuucgcgggcguaaacggaauagccgccaacgaacgcagacuaccgaaagcccacccacuguuucagcagcgacgacuguacgaagaaguaaaccaacuacgcauagucucagcgggagcagcagacagaccacugacacuagacgaacgcgaccgauuaauucuccgacugcaagaccgaaagaaagugagcuucgacacacuugcaaagaaagaccuccggcuagccgacggcgaacgauuuaacaaagaauccgaaaaccgcaaagaacuuaucggggacgaaguccgcgccgaaaugagcgacaagaaaagauuuggaaccagauggguccacuuuggacucgaugaacaacugcggauacuagccaaacugcaagaugaggaaaacccggaagcucuccuagacuggcucaggucagaauacggccucgacgaagcagcagcagaaucggucgcaaacgccagacuaccugaaggauacgggcgcuucggcgagacggcaacacgacuacuacucgacgcacucaaggccgaagucauaacguacgacaaggccgcacuucgggcauucggucaccacagcgacuuccgaaccggcgaggucuuagaccgccuaccauacuacggagaacuacuaacgagagaaaucgcacccgguaagcccgaauacggagacccacuagaacgccaguacgggaaaaucaccaacccaaccguacauaucggacuccgucaacucgaaaaacuugucaacgcagucaucgcaguccauggccgcccugaucaaaucguagucgaacuagcgagggagcuuaaacucaacgaaaaagaaaaggaugaacacaagcgacggauaaaacgcgacaccgacgccgcaaucgcacgcggccgcaagcuagcaucagaaggcuucaucgacaacggugccaaucgcaugcuaaugcggaucugggaggaacucaacccagcaaacccacuggacagacgcugucccuacugugccgaaccaaucggaaucagagcacuauucucaggagaagccgacauugaccacauaauaccauacucacgcucccuugacgauaacguagggaacaaagucguagcucaccgcuccugcaaucgagccaaaggaaacaagaccccauacgagaaauggggaccgcacauugacccagaaagaugggagcgaaucagcgaccaagucgcgaggcuccacaaaucgaagcaguggcgcuucggacccgaugcaauggaacgaaucgaucgagauggaggguuccuagcgcgccaacugacggacacccaguaccucucccgaguagcgggcaaauaccugagaucgcucuaccccaccgcacaaagcggacgagucgaugugauccccgguagaaugacagcaaugcuccgccgaaaguggggccucaacagccuacucccagaccacaacuacgucgaaaaugaacauucaaacgcacccaaaaaccgccuagaccaccgucaccacgcaauagacgcagcgguugcagcggugacgaccuugucucuaaugcaacagauagcagacgccgcgggucgcgcagaagacaaaaaccuagauagacucuucgaagacaucccacagccauggcccgguuuucgagaagaacuaggagaagccuugcgaucaaccacuguaagccacaaggcagaccacggacgcaaacgaaggcccagccgcgaccgagacgucacggccgcacgccuccacaacgauacagccuacgggcucacaggagacguugcagccgacgguaagacccccaucgucgugcaccgcguaccccucgcaucccucaaaccagccgaucucauagacccacuccgaaucccggacccgguacuccgggacgcgcuauacgcugccacccgcgaucgaaccggaaaagaguucgaacaagcccugacccaauucgcacggcaccacccacuauucaaaggaaucagacgagugcgcgugcgcgaaccacuaaacguaauccccauccgcgacgcggcagggagggccuacaaggccuacaagggagacgcgaacgccagauucgaugucuggcgccucccaaacggaaaaugggucuccgauaucgucucaauguucgaugcacacugcauggcagacaaguccgaccgaagaccccacccagcagcaaagaagguacucucacuucggcaaaacgacauggucgcaauugaaagaagcggagucacgcagaucgcccgugugguaaaauucucuacuaacggauccaucgcauuggccgccgacaacgaagccggcgcccuaaaggcaagagacgccgcgcccaacgacguggaucccuucaaauacauauucucguccggcggcggccuaaagaauuuaaaagcgcgccaaguacgcgucgauccccugggucgaguauucgacccaggaccgcgcgaguga

SEQ ID NO: 7295 - RNA, 3177 nt, Artificial Sequence
  Cas9 variant
augaagaacucauacauccugggccucgacguggggaucgccagcgucggcuacgggcugauccacagcgauucgaagucagugaucgacgccggugugcgacuuuuccccgaggcuaaugucgagaauaacgaggggcggcgagccaagaggggguccaggcggcucaagcgccggcgcauccaccgccuggaccgcgugaaguaccuguuagcccaguaccaccugaucaucgacgacaaaauccccaagagcaccaaccccuacgccauccgggugaaaggccuguccagcgcccuaaguaagagcgagcuggucaucgcgcugcuccaccucgccaagcgccgggggauccacaacguuaaugucgucauggaugagaaugaguccaccaacgagcuguccacgaaggagcagcuuaaggagaacgccaaacagcuggagaaccgcuacgugugcgagcugcaacucgaucggcugaacgagcaguacaaggugcgcggcgagaggaaucgcuucaagaccgaggacuucguacgggaagcccgccagauacucaccacccagcagaaguaccacgacaucgacgagcacuucaucgagcaguacacucaccuccuggagaccaggcgcgaauacuacgaggggcccggcaaggggucccaguacggaugggaaggcgaccucaagcagugguacgagaugcucauggggcgcugcaccuacuuccccgaggagcugcgcagcgugaaguacgcuuacaccgccgaccuguuuaacgcucucaacgaccugaacaaccucgugaucgcccgcgacgagaacgagaaacucgaguacuucgagaaguaccacaucaucgagaacgucuucaaacagaaaaaguccccgacguugaagcagauagccaaagaaaucgacgugaaggagagcgacaucaagggcuacaggaucaccaagaacggaaagccccaguucaccuccuucaaacuguaccacgaccuaaacaagaucuuccucgacaaaaagaaccuggagaacauagaacuccuggacgagaucgcguucauccugacguuguaccaagacccccugucgaucaaagaggcccuggaccaguuacaggaccugcugacggaguccgagaaggaggccaucgcccaccucaauggcuacaccggcacccaccgccugagccugaagugccuccaccuccugauugacgagauguggcagaccagcaggaaccagauggagguguuuacggcacugaaccucaagccccagaaguaccagcuauccaagcagaagcagaucccgaagaagauggucgaggaguucauccucucacccguggugaagaggucuuucauucagagcaucgaaaucgucaacaccaucauuaagaaguacgggcuccccgaagagaucauuaucgagcuggcgcgggagaaaaacuccgaagaccgccggaaguuccugaaccgcauccagaaggagaacgagaacacccggaagcaggucgaggaggugauccgcgaguacggcaaucggaacgcaaagggguuaguggagaagaucaaacugcaccagaugcaggagggcaagugccuguacagccuccagaacaucccccuggacgaucugcuccgcaacccgucucacuacgagaucgaccacaucaucccacggagcguguccuucgacaacagcuucaacaacaaaguccuggugaagcaggaggagaacuccaagaaggggaaccgcacucccuaccaauauuuaaacagcaaugaguccgugcucagcuacguccaguucaaacagcacauccugaaccuguccaagagcaaggagcggaucucaaagaagaagcgcgaguaccuccuggaggaacgggauaucaacaaguucgaggugcagaaggaguucauaaaccgcaauuuagucgacacgcgcuacgccacccgggagcucguccagcugcucaagagcuacuucuccgcgaaugaccuggacguaaaggugaagacaaucaacggcagcuucaccaacuaccugcgcaaggccuggaaauucgacaagucccggaacaagggcuucaagcaccacgcggaggacgcccugaucaucgccaacgucuccuaccucuucaagcagagcaaagagcugaaggaggccaacgccauucuggagaacaacaaccucucccugaauaagaacaaggacucgaaaaacuugcucacggagcaggacuaucgaaagauguucgagauccccaagcagguccaggacaucaaggacuacaaggacuucaaguacucgcaccgggucgacaagaagccgaaccgccagcugaucaacgacagccuguacuccaccagggaggugaacgaaaaccacuacaucgugcagaccgugaaggacaucuacgcgaaggacaacaccaagaucaaggaccucuuccugaagacuccggaaaaauuacucauguaccagcacgacccccaaaccuucgagaagcugaugcuggucaucaagcaguacggugaggagaagaaccccuucgccaaguacuacgaggagaacggcgaguaccucaccaaguacgccaagaacgagaaggggccgaccaucaagaggcugaaguacaucggcaagaaagugggaacgcaucuagacaucagcaccaauuucuccggcgcaaagcggaaggugguccagcucagcaucaagcccuuccgcuucgacgucuuccacuccaaagcgggcuaccauaugcugacccugaccuacauggacauaaagaagaaggagaagcacuaccagauccucaaaaaugaauaccaggcccugaaggagcgguacaaggugcccucagacgcccaguucaucgguucuuucuacuacaaugaccugauuagcaucaaugacgaacuguuccgcgucauuggggugaacaacuccacgaggaacguggucgagcugaacaugguggacaucaacuacaaggacuauugcgaccugauggggaucaagaagaccccucgcaucuuuaagaccaucaccaagaagaccggcaagauugagaaguacagcacggacauacuggggaaccaauucaaggugaagccauccaagagcccccaacugaucuucaagcggggcguccucuga

SEQ ID NO: 7296 - RNA, 3180 nt, Artificial Sequence
  Cas9 variant
augagacgacucggacuugacauagguaccaacuccauaggcuggugccucacacaaggccccggcgacgaagccgacgggaucguggacauaggcgucaggaucuucagcgacggccgagauccacaaagugguacgagccucgccgucgaccgccgagacgccagagcagcucgacgccgacgagaccgguauauaggcagacgaagcgcauuccuagauacccuagucgcacacggccucaugccggcggacgcagacgaagcaaaacugguagccgcacuagaccccuacacacuccgcgcccgagcccuagaggcaccgcuaacaccccacgaaaucggacgagcucuauuccaccuuaaucaacgaagaggauuuaaaagcaacagaaaagcagaaagaaaaaccaacgacgcggacgacggaaaaauagccacagccgcauacgcccucgacagagccaugcucgacggaggguucgacacccuaggccaauuccucaacgcccaagaaacaaaacgcguccggauggacggcgaagcccagggguacgacuucuacccccaaaggcgccacguagaauaugaguucgaccgaauauggacagaacaagcaaaacaccacccggcacuccucacggaaacggccagauaugcgcuacaccgcauccucuucuaccaaagaccacucaaagcacaagucgucggaaaaugcaccuucguccacucugaagaccgacuagcaaaagcccacccucuguuccaacaaagacgccucuaugaagaagucaaccagcuagaaguaaccaccccaggagaagcaaaucgaaagcucacacuggacgaacgagaccgacucguaagagaacuaucccacaagaaagcuaucgcauucaccucgcuagcggccaaaauuaagcucgaacccggacagagcuucaacaaagcaucagaaaccagaacacaacuggcaggcgacgagguacgcgccguauuaggcgauaaaaagcgguucgggcccgccugggaacacuuugaccgagaccgacaauggaccaucguagaaagacuacuagaagaggaagacccagaugccuuacacgccuuccucacacaagacuguggccucgacgaugaacacgccgcagcaacagccaaaacaucacuccccgaaggauacggacgacucggcgccaccgcaacagcccgcauacuagccgaacuacaagcagaagugauaacauacgaugaggcgguccgcagaugcggauggcaucacagugaccacaggaccggagaaauucucccacagcucccauacuacggcgaacuccuaacccgcgacaucccucccggcacacaggaucccaacgacccaccggagaaaagauggggacgaauuacaaacccaacaguacacaucggacuaaaccaggucaggcaauuaguuaaugcuauaguagcagugcacggacgacccgaccagauuguaguagaacucgcuagagaacucaaacugaacgaaaaagacaaagaagaacauaaccgccgcauacgacgcgacaccgccgcagcaaucaaaaggucggaaaaacucacucaagaaggcuucccagacacaggagccaacagaauguugcuucgccuaugggaggaccucaacccagcaaacccucuagaccgccgaugcccauacugcggcgcccccauaggaaugagagcacuauucgcaggcgaagcagacguggaucacauaauuccauacucuagaagccucgacgacuccgccggaaacaagguaguugcacaccgauccugcaauagggcgaaaggaaacagaacccccuaugaaaaauggucugacgacccggaccgaugggacgcaauaacggcacagguagccagacuacacaggucaaagcaauggagauuuggccccgacgccauggcccgcguagaaaaagacgggggcuuccuaucacgccaacucacagacacccaauacuuaagccggcucgcgggccgauaccugagcucccuauacccaaccaaggaggaagggucagucuaugucauccccggacggaugacagccaugcuucgaagacucuggggacucaacgacauccucucggaccacaacauaguagaaaacaaacacagcaacgcccccaaaaacagacucgaucaccgacaccacgccauagacgcagcagucguagcugugucaacacgcucucuaaugcaacgaauagcccgcaccgcuggacaggccgaagaccggaaccuagacagacuauucgaagggcuggacccaccguggcccggcuucagagaccaacuacgugaccgacuacuagcggucacaguaagccacaaggcugaccacggccggaccggcaccccagucccuggcaaagacgcaaccgcgggccgccuacacaacgacacagcauauggccugacgggcgaaacaagcgcaaagggauuacccauaguaguccaucgcgugccccugaccucccucaagcccgcagacauuacggauccagaucggaucccugacccggugcuaagagacgcgauugaaagagccacagcaggcaaaaugggcaaggacuuuacagaugcccuagcaaaauuuggacgaucaggagcccaagaaacagacagaaagggcgaacgacucuuccgcggaacccgacggguaagaguccgagagcccuuaggggugauaccaauagcagaugcauccggccggguauacaaagcauacaaaggcgacuccaacgcacgauucgacguauggagacuaccggacggaaagugggucucagacauugucaguauguucgacgcucaccgcccagaccaaggcgacagacggccacacccagccgcaaagaaaguccuaagccugcgacaaaacgacaugauagcaauagaacgcgacggggcaccacgagaaauaguacgcguggucaaauucagcacgauagggucgguacagcucgccgccacaacagaagcugggccccuuaaagcacgggacgccuccccacccgacguagaccccuucagauacauaaacuccuccgcgggcggacuaaagaaaaucaaagccaggcaaguccguaucgauccccucggccgaauauucgacccgggcccccgcuga

SEQ ID NO: 7297 - RNA, 3180 nt, Artificial Sequence
  Cas9 variant
augaucgagaggauccuaggcguagaccuaggcauaagcucgcuaggaugggcaauagucgaauacgacaaagacgacgaggcagcaaaccgaaucauagacugcggagucagacuguucacggcggcagagaccccuaaaaagaaagaaagcccgaacaaagcgcgaagagaagcacgcggcauaaggcgaguccucaaccggcggcgaguacggaugaauaugaucaagaaacucuuccuccgcgccggacucauacaagacguggaccuggauggggagggcggcauguucuauuccaaagcaaacagagcagaugucugggaacugaggcacgacggacuauacaggcuacuuaagggugaugagcuggcccgaguacucauccacauagcaaaacaccgaggcuacaaauucaucggcgacgaugaagcggacgaagaaagcgggaagguaaagaaagcgggaguaguacuacgucaaaacuuugaggcugccggaugccgaaccgucggagaauggcuauggcgggagcgaggggccaacggaaagaaacgaaacaaacacggggacuaugagaucuccauccauagggaccugcuaguagaagagguagaggccaucuucguggcccaacaagaaaugagaagcaccauagcgacggacgcacugaaagcagcuuacagagaaaucgccuucuucguaagacccaugcaaaggauagaaaagauggucggacacugcacuuacuucccagaagaaagacgcgcccccaaauccgccccgaccgccgaaaaguuuaucgccauaaguaaguucuucagcacaguaauaaucgacaacgaaggcugggaacagaaaaucauagaacgcaagacacuagaggaacugcuggacuucgcagucagcagggaaaaagucgaguucagacacuuacgaaaauuccuggaccucucagacaacgaaaucuucaagggucuacauuauaaaggcaaacccaagacagcaaagaaacgagaagccacacuauucgaccccaacgaaccgacagaacuagaguucgacaaagucgaagccgaaaagaaggcguggaucagccuacgcggggcagcuaaacugagagaagcacuagguaacgaguucuacggaagauucguagcacucggcaaacacgcagacgaagcaacgaaaauauuaacauacuacaaagaugaaggacagaaaagacgcgaacuaacaaaacucccacucgaagcugaaaugguagagcgacucgugaaaauaggguucagugacuuccuuaaacucagccuaaaagcaauccgcgacauacuaccggccauggaaucaggugcacgauacgaugaggccguacuuaugcugggaguaccgcacaaagaaaagagcgcgauauuaccuccccucaacaaaacggacauugacauccucaacccgacggucauacgagccuucgcacaguuccgaaagguggcgaacgcacucguacgcaaauacggggccuucgaccgcguccacuucgaacuagcgagagaaauaaacaccaaaggagaaauugaagacaucaaagaaucacagcggaagaacgaaaaagaaaggaaagaagccgccgacuggauagccgagacgagcuuccaaguaccgcuaacacgcaagaacauccugaagaaacgccuguacauccaacaggauggucgcugcgcguacacaggagacgucaucgagcuggagagacuguucgacgaaggguacugcgagaucgaccacauacuaccacgaagccgcagcgcagacgacucguucgccaacaaaguccugugccuagccagagccaaccaacagaaaacagaccgcacgcccuacgaaugguucggacacgacgcagcaagauggaaugccuucgaaacaaggacaucagccccaucgaaucgcguaaggaccggcaaaggaaaaaucgaccgacuccucaagaagaacuucgacgaaaacuccgaaauggccuucaaggauaggaacuuaaacgacacacgguacauggcacgcgcgaucaaaacauacugcgaacaauacugggucuucaaaaacucccacacaaaagcgcccguccagguaaggucaggcaaacuaacaaguguacuccguuaccaauggggauuggaaagcaaagaccgagaaucacacacccaucacgccgucgacgccaucauaauagcguucagcacgcaaggcaugguccagaaacuaagugaauacuacagguuuaaagaaacacaccgagaaaaagaacggccaaaacuagcagugccccuagccaacuucagagacgcaguagaagaagccacuaggaucgaaaacacagaaacggucaaagagggcguagaaguaaagcgccuacuaaucagccgcccgccacgcgcaagaguaacaggccaagcacacgagcaaaccgcaaaacccuacccaagaaucaaacaagugaaaaacaagaaaaaguggcgccucgcccccaucgacgaagaaaaauuugagagcuucaaagcggacagaguagccagcgcaaaucaaaagaacuucuacgaaacguccaccaucccaaggguggacguauaccacaaaaagggaaaauuccaccuaguaccaauauaccuacacgaaaugguccugaaugaacugccgaaccugagccuaggaacgaaccccgaagccauggacgaaaacuucuucaaauucagcauauucaaagacgaccucaucagcauccagacacagggcaccccgaaaaagccagcuaaaauaaucauggguuacuucaaaaacaugcacggggcaaacaugguacugucauccaucaacaacagcccaugcgaaggcuuuacgugcacaccaguaagcauggacaaaaagcacaaggacaaauguaaacuaugcccagaggagaaccgaaucgccgggcgcugccuccaaggauuccuagacuacuggucucaagagggucucaggcccccgaggaaggaguucgaaugcgaccaaggagugaaauucgcacuagacgucaagaaguaccaaauagacccacucggauacuacuacgaaguuaaacaggaaaagcgccugggcaccauaccccagaugagaagcgcaaagaaacucgugaagaaauga

SEQ ID NO: 7298 - RNA, 3180 nt, Artificial Sequence
  Cas9 variant
augagcaaacgacugagguacagguuggcacuugaccucggaacaaacagcauaggcuucugcuugcuggaccucaacggggacggccgcccgugcggcgucagaagaaugggaguacgcauuuucccagacuuuagcaaacugcaacagucccuagcagcagacagaagacucgcacgcucaaugaggcgcagacgggaccgauaccuaagacgacgaaaagcccuaaugaacgcgcuaguggcagcagcacuaaugccagcagauccaaaagcaagaaaagcgcucgaagcccucgacccauacgaacuacgcgcggcggcaguagcaggcccacucccagcccaccaacucggacgagcacuauuccaucucaaccaacgcaggggauuuaaauccaaccguaaagcugcgggagaugaaaacgaagcaggcaaaguaaaaagcgggauaagcgcccuaaaagcagagcucgcagccucaggcgcaggaacccucggacaauggcuggcagcgagacacgcaaacagacaaccaguaagggccagacucacggguacaggcgcaaaagccacauacagcuucuacccagaacgagcgcuaguacacgaggaauuucaggccauccgagcagcgcaagcaccgcaccacccuggcgucacagcagaacaaugggauagaauagagucagugauauuccaccaaagaccgcuaaaaccagugaagcccgggaaaugcacauuauacccagaggaagaaagggccccgugggcguuaccaauagcacagcgauuccgaauccuccacgaacuacacaaccuaagaaucgugcgcccaggccagggagaagaaggccuaucacccgccgacuucgacagguucuuugaccgacugugcagaaaaggagaccugacauucaaaacccuagccaaagaacucaaauuaccaccagacgcacguauaaaccuagaagaugacaaaagagacaggcugaaaggagacgcaacagccgacgcacuaagcgcagaaaaagguaaacgaagacgaauaggcgcagcauggcacaguuucccagcggaucggcagcgugagauaguaggcaggcuaauagacgccgaggacgaaggggagcucgcggccuggcucguagaggaacuaggccuacccugggaagucgcaaucuuaacggccgaacgcccaggacuaccagacggguacugccggcuauccgaaaaagcacucgaacaggugguaccucuaaugcaugaggagcacuugcccuacgacgaagcaguacgggcgcuaggacuccaccacuccgaccaucgcaccggagaguuccuagaugaacugccguacuacggccucccgcucgaaagauucaucgccuucggaacaggggaggcagacgacccacccgaauuaaggaucggccgauucccgaacccaaccgugcacguugcacuaaacgaacuacgccgcgucgugaaccgaauaauacguagauggggaaagcccgaggaaauagugguagaauuagcccgcgaccuaaaacaaagcagagcagaccgagacaagacccaaagagaacaagccgauaaccagaagaaaaauuggacaaggacgcagcaacuacgcgagcucggcauggaaccgacaggugaagcacuacuaaggcuacgacucugggaggaacucccacgaauaggaucggcccauguaugcguauacacaggacaaccaaucuccaugacgcaguuacuacaaggcgacguagacguagaccacauccucccauucuccagaacacuggcaaauggcgcagacaacaaaaucguaugccacaggagggcaaauagaaucaaacgcaaccgaacaccaugggaagccuucggagucguaucggcagacggauacgauugggccgccaucgcagaaagagcggaaagccuccccaaaaacaagcgcuggcgcuuccuccccaacgcaauggaacgauucgaaacugaacggggauuuauagacagacaacugguagaaaccagacaccuaagccgcgucgcuagggaauaccucggaugcauaguaccacuagaaaaaguccgagccgcacccggaagacuaaccgccaugcucagaggccgcuggggccuaaauagcauccucucggacgcgaaccucaaaaacagaucagaccacagacaccacgcgguagacgcagcggugcuaggcgucaucgaccaacgcuuaguacaaagaguagccgacgcagccaagagagcagaagaaaaagagcuagaaaagcuauucgacggccucccagaccccuucgaaggguuaccuggccccagcuuccgcgaccaaguccaagaaagggcacaaggaauaauagugagccacaagccagaacacggauggcagggaaggaugcacaacgacacggcauacggcccaguggaaagacugccagacggaacacacagaguagugacaaggaaaccacucggcagccuagcggaaaaagacuucgggaacauccgagaccgcgcacuagcagcagcacucgaaagacacguggcagaacaagcggcacaaggaagaucgcuaggagaggcacuaucgugcuucaccuggaccggcggggaagucagacggguaagaaugcuggacaaacuaggcucgccaguagcaguacaggacgacgauggacacacauucaaacuauacaaaggcgacagcaaugcaugguacgaaauacuacgagacggaagagggcgcuggacaggacgcauagugagcacguacgaggcauaccgccuccacgcagaguggcuggccgagcgcggagacggaggcagaagcgacgccgcguucccggacugggcagcaagacgccucugcgcagggaucggaaaaccacuauuccgacucuucaaaggcgacaugcuggccuuuggaaccgcaccgaaccgagaaauaaugaaggucguaaaauucagcgagggacggaucguguucgcaggacacagagaagcaggaaacuuaaaagaaagggacgcagacaaagaugauccauuuaaguaccgaacaugcagcccugaagcgcucaggaaagcucaagcgaggccggucggcgucgacccagccggcuucguacacgacagaggaccccuugaauga

SEQ ID NO: 7299 - RNA, 3180 nt, Artificial Sequence
  Cas9 variant
augggaaucagauucgcguucgaccucgggacaaacagcauuggaugggcggucuggcgaacaggaccaggaguauucggagaagacacggccgcaagucuagacggaagcggaguccugaucuucaaagacggaagaaaccccaaggacggccagagcuuagcgacaaugcgaagaguaccacgacagagccgaaaacggcgggacagauucguacucaggcgccgcgaccuacuagcggcacugcggaaagcuggacucuucccgguagacguggaggaagggcggagacuagcagcgacagacccguaccaccuaagagcaaaagcacuagacgaaagucucaccccacacgaaaugggaagggucaucuuccaccugaaccaaagaagaggauucagaagcaaccggaaagcagaccggcaagaccgagaaaagggcaagauagcagaagggagcaagcgccucgccgagacccucgcagcaacaaacugcaggacacucggagaguuccuauggucacgacaccgcgggaccccaaggacuagauccccgaccaggauacgcauggaaggagaaggcgccaaagcccuauacgcauucuauccgacaagggagaugguucgagcagaauuugagcgccuguggaccgcacaaucccgcuucgcaccagacuuacucacaccagaaagacacgaagaaaucgcaggaauccuuuuucgacaacgugaucucgcaccgccgaagauagggugcugcaccuucgaacccagcgaaagacgauugccaagagcacuaccuagcguagaagcacgggggauauacgaaaggcuagcccaccucagaauaacgaccggccccguaagcgaccggggacuaacacgccccgagagagacguacuagcgagcgcauugcuagccggaaaaagccucacauucaaagcgguccgaaaaacccugaaaauccucccccacgcccucgucaacuuugaagaggccggggaaaaaggacuagacggggcacugacagcgaagcuccucucaaagccagaccauuauggggccgcguggcacggccuaucauucgcagagaaagacacguucguaggaaaguuguuagacgaagcagaugaggaaagacuaaucagacgccucguaaccgaaaacaggcuaagcgaggacgccgcgcggagaugcgcguccauaccacuagcagacggauacgggcgauuagggagaacggcaaauaccgaaauccuggcggcccucguagaagaaaccgacgaaaccggaacaguggucacguacgcagaggcaguacguagagccggcgaaagaacgggaagaaacuggcaccacagcgaugaacgagacggggucauacuagaucgacuaccguacuacggggaaauacuacaacgccauguaguccccggaaguggugagccggaggagaaaaaugaggcagccagguggggccgauuggccaacccaaccguccacaucggacuaaaccagcuaagaaaagucguaaaccgacuaaucgcagcacacggacguccagaccaaauagucguggaacucgcacgagaacucaaacuaaaccgagaacaaaaggagcgacuagaccgagaaaaccgaaagaaccgcgaggaaaacgagagaagaacggcaauccuagccgaacacggacagagggacaccgcagagaacaagaucaggcugaggcuuuucgaagaacaagcaagagccaacgccggcauagcacugugccccuacaccggaagggcaauagggauagccgaacucuucacgucagaaguagaaaucgaccacauccucccaguaucccugacacuagacgacagucuagcaaaccguguccuaugucggagagaagcaaacagggagaaaagaaggcagacaccauuccaagcauuuggcgccacaccagcauggaacgacauaguagcaagggccgccaaacuaccgccaaauaagcgauggcgguucgacccagcagcgcuggaaagauucgaacgagaaggaggauuucuaggaagacaacugaacgaaaccaaguaccuaucaagacuagccaaaaucuaccucgguaaaauaugcgaucccgacagggucuacguuacuccaggcacgcuaacaggacugcuaagagcaagauggggauuaaacucaauccucagugauucaaacuuuaagaaccgaagugaccaccgacaccaugccguggacgccguugucauaggaguacugacgagagggaugauacaacgaauagcccacgacgcagcccgggcugaggaccaggaccuagaucgagucuuucgcgacguaccaguccccuucgaagauuucagggaccacguucgcgaacgagucagcacaaucacgguagcggucaaaccagaacauggaaaaggaggagcacuacaugaggauacgucauacgggcuaguccccgacacagacccgaacgccgcacugggcaaccuagucguacgaaaacccauccggucacucacagcaggcgaaguagacagggugcgggauagagcccucagagcccgacuaggggcacucgcagccccauuccgagacgaaucaggccggguaagagacgccaagggacuggcucaggcccuggaagccuucggagcagaaaauggaauaaggcgagugcggauacuaaaacccgaugcgagcguagucacgauagcagacagacgcacaggaguaccguacagagccguagccccaggugagaaccaccacguggacauagugcaaaugcgcgacggaagcuggaggggauucgcugcaagcguguucgaaguaaaccgaccaggguggagacccgaaugggaaguaaagaaacugggagguaagcuagucaugagauugcauaagggagacauggucgaacuaagcgacaaagacggccaacgcagggucaaggucguacaacaaaucgaaaucucagccaaccgaguaagacuaucgccacacaacgacgggggcaaacuacaagaccgccacgcagaugcagacgaccccuuccgaugggaccucgccacgauaccgcuacuaaaagacagaggaugcguagcaguaagaguggaccccaucggaguggucacacuaaggagaucaaauguauga

SEQ ID NO: 7300 - RNA, 3183 nt, Artificial Sequence
  Cas9 variant
auggcugucaaaucccuaaacuacauccucggccuagaccugggaaucgcuucaugcgggugggcaguaguagaaauggacgaacaagagaacccccuucggcuaaucgacgucgguguccgcacauuugaagaagccgaaaaccccaaagacggcucaagccuagcugagacccgacgacuagcacgcgcgcaacggcgcuuaauaucccgacgcgccaaccgaaugaauaaacuacggcgccuacuuaaacaggaaaacguauugcaagccaacgacuacgaugaaaaaggacucaucaucgggcucccaaaccaagcaugggagcugcgcgcacaagggcucgaccgaaaacucgagcccaaggaaugggcagcaguacucauccaucuugugaaacacagaggauaccugucccagcgaaagaacgaaucccaaaccgccgacaaagaauugggcgcacuucuauccggaaugaaccacaaucaccaacuacuacaaagccaaagcaaccaguaccgcaccccugccgaacucgccaucaaacaauucgcgacacaagacggccacauacggaaccagcgcggcgcguacacccacacuuuuaaccgccuugaccuacaaaaugaauuaaaccaacucuucgacgcucaaacccgucuagggaacccccacgucuccggaagucucaagacggcaaucaacgaccuccugaugaaccaaaaggccgcgcuaagcggcgacgcaauccuagaaaugcuaggcagaugcacauucgagcccagcgaauacaaagcagcaaagaacaccuauuccgccgaacgguucgucuggcuugggaaacucaccaaccuaaggauucaagacaauggccuggaaucugcccuuucuagagaacaacgggaacuucuacucaaugaacccuacaacaaaacaaaacucacuuaucaacagguacguaaacuccuccgccuccccgaaacagccuucuucaaagggcuacgcuacggcaaggacaaugcagaaucagcaacacucauggaaaugaaaagcuaccacgccauaaggaaaucacuagaaaacaaaucgcuaaaaucagaaugggaaaagcucaaaacacagcccaagcuacucgaccuuauagggacagccuucucaauauacaaaaccgacgaugaaauugcaggaugucucaagaaucaacuccccgaaaacguaaucauagcccuccaagagcaacuuaacuucuccaacuucauggaacuaagccucaaggcacuagaaaaacuacucccucucauggagcaaggccuccgcuacgacgaggcuugcacacaaauauacggcaaucgccacgaaaagaucgccgacaaaacggaaaaauuccuccccaacauuccugcggacaaacuacggaaucccgucgugcuccguacacugacccaagcacgcaaaguaaucaacgcgauaauccgacgcuacggaagccccgccagaguccacaucgaaacuggccgcgaagucggaaaaucauucuccgacagagauaaacuaaagaaacaacaggaagagaaccaagaacagcgacgccgagccaucgacgaauggaaacaauucuuccccaacgcagcccacgaacccaaagccgucgacauacuuaaacuccgccuguaccaacuccaacaaggcaaaugccucuauagcggccugccuauugacgugagaagauuacccgaaaaaggcuaugucgaaaucgaccacgcacuacccuucucacggacgugggacgauucauucaauaacaaaauccuaguccuagcuuccgaaaaccaaaacaaaggcaaccaaacaccguacgaguaccuaagaggagcagauaacagcgaaucauggcgccuguucgucgaaaacguucagaacugccaguucucacccaauaaaaagcagaaaauaauggccaaacagcucgacgagaagggcuuccucgagcgcaaccuaaacgacacgagauacguguccagauuccucugccaguucaucuccgaauaccuccaccucaccgggaaagguaaaaagagaguauucgcuagcaacggccagaucaccgcucugcuucggggcagauggggacucagcaaaaaccgugaagaaaacgaccgacaccacgcgguggacgcaguagucguugcgugcuccaccguggccaugcaacagaaaaucacccaauucgucagauaccagaaaggcaacguguucaccggcgaaagaauagacaaagagacaggcgaagugaucucgauacacuuccccacacccugggaacacuuccgcgaagaagucaugauaagggucuucgacgacaaccccuuacgcacccuucccgaaaaacucccgaacagaccagaagcacuacacgaauacguuaugccccuauucgucucccgcaugccaacacgcaaaaugaccggacaagggcacaaggaaaccauaaagagcgcaaagagacucgacgagaaaauauccguccucagagucccucucacccaacuaaaacuuaacgaccuugaaaacaugguaaacagagaacgagaaccggcacuguacgaagcacucaaagcccgccucgagcaauucaaaaacgaccccgccaaagccuucgccgaaccauucuucaaacagggcggccaacaagugaaggcaguacgaguggagaucguacaaaagagcggaaugcuccucaggaaaaucaacgggguggcagacaauggcucgauggucagaguagacgucuucgagaaaucugggaaguucuaccuaguccccauauacgcauggcaagucgccgaaggcauacuaccgaaucacgccgucguacacuccaaagacgagucggacuggauccuaauggacgaauccuaccacuuuaaauuugcccuguacaaaaacgaccuacucgagguccaaaccaagaaaggaugcaucaugggauacuucgccucccucgaccgugccaccggggccaucacuauccgcgaacacgaucgcgacaaaaagaaaugcaaagacggcgagcaccgcagcaucggugugaaaauggccaguagcuucaaaaagcugcaggucgacgaacucgggaaaaacauacacgagacccgaaguagaaaacgcccaaauaucgguuga

SEQ ID NO: 7301 - RNA, 3186 nt, Artificial Sequence
  Cas9 variant
augcauacacugcccuacacauuaggccuagacaucggcauagcauccguaggcgcagcacucuuaagcgaugaaucaauccugggaaugcacguacgaaccuucucggcagccgagacagacaaagaaggagacccacuaaacaaaauccgacgagaggcccguuccgcaagacgacgaauaagacgacgcgcccauagacuccuacggcuccgccgcuuacucaaacggacuggccugaucucagacaccagccucgaaguccucaaaaccucaaaaaccccuuggcaacucagauccgaaggccuagaccgccuucucuccccaagcgaacucgcugcggcgcucuaccacauuguaaaacaucgcggauuccaguccaacagaaaagcugaacucaagaccgacgccaaagcagggcagaugcuuagcggcgucucagccaaccaacaacuaaugagagacaagucauacagaacaauagccgaaaugguaugcaaagacgacgcguucaaagaucacaaacgcaacaaaggggguuccuaccgcaacaccuucgcgcgaagcgaccucgcggacgaacucaaaacauuacuaaagaaacagcgcgaauacgauaacccacucgccacccccgaacucgaagaagccguucauacgcuacugauggcccgcagacccgucuucaaagacgacgauauagaaaaacucgucggguucugcacuuuugagcacggagaaaaacgcgcgcccaaagccgcuuucuccucugaacgcuucauauggcucggcaagcucaacaacuuacgccugaucuaccccggcgagcaacgcucccuaaccccugaagaacgaucccaaauaauaaaucucccguucacccaggcauccgugaaauucagccaaauccgcaagaaacucgaccuaccggaauacguccgguucaacuuaguccgauacaaacccggagaggagaccagcaaaagcgaaacggccacauucuucgaggccaaagccuuucacgaacuacgcaaaaccuaccgagaaucaggcauuucagaacugugggaacgggaccaacacgacccacaaagacucgaucagaucgcgaccgccauagcggucuaucgugacgacgagcgcauccgaaacgaauuaaguccacauacgauagaaaacgaaguaguggaagccguccucaacugcgacuucacccaauucauaaaccugucccuuaaagcccuaaacaaaauacuaccguacauggaacagggacaacgcuacgacgaggcuugcacuucggccggcuaccaacaccacagcccacaacagaaugaggaaaaaucagggcgcauacccccacccgacaaaaacgucaucagaaaucccguaguguaccggucccucaaccaagccagaaagcuaaucaaugcaaucaccaagcgauacggcgcccccgcugccauccaccucgaaauggccagagaccuaucuaaacccuucagugagaggaaaaguaucgaaagagaacaagaaaaauaucgcaaacaaaagguucagcuaagaaacgaauacauagaacacuucggaaccgagccaaacggacuaaaccuucuaaaauucagacuauacaaagaacaagacgcgcagugcgcguacacucaaaaagcccucgaucugagccgacuaaacgaagccggauacguagaaguagaccacauacugccauacagccgaucauacgacgacucucuccuuaacaagacacucguccucaccgaggccaaccgcgacaaggguaaccgcacccccuucgaguucauggguggcgacgaccaaucacaacacuggcagaaguucguccgauggguacagaugaaccccaagauccgccaagccaaacgcaaccgauaccucagaaaagacuucucggaaaaggccgcccgcgaguuccgcgacagacaccuaaacgacacacgguacauaggcagagaacugaaagcgaugauugaaucccacguccaguggcacccggacucaaagucaaaagauugcugugucguacucuccggacaacugacagcacuacuucgaggacgauggggcuucaauaaagaccgcgcggccggcgacuugcaccacgcuguggacgcagccgucguagcugcagcgacuagaggcaugauucagcgaauggcaagacacucgaaauuucacgaacucaaaaacguacgcacaaguuaugccgauccugacacaggcgaagucgugaaccucgcagccgccagagaccuagaaaaacacuucccacuaccgugggacaacuuccgcaaugacacccuagcauaccuaaacccgagcgccauaagcgccgacgagucggcccaggaaggccacagaggcguaagagucagccgcgcccccacacgacguaaacucggagccgcacaccaggaaacuauaagaagcaagggaaaggacaacauccuccuggaacaaggccuaagugccgucaaaacaccccugagcaaacuaacccuuaagaacaucgaaaauaugguaggcuacgaggacccaagaaacgcagcccucgucaagguccuccgagagagacuagaagccuucggcggagacggagcaaaggcauucgcgcccaaccaaccaccaguauacaaacccuccaaacccggcaaacaagcccccgaaauccgcagcgugaaaauggcaagcaagagcaaaggcgcacuacacguacgagagggccucgccgacuccggccgaaugauaaggaucgacauauaugaaaccaaaaacggauauguggggguccccauauacguauccgacaaagcaagguccaaacuccccaaagccuaccccaagaagggagaagaccgugccaacuggccugaagucgacacaaacgacaacuuccucuucucucucuacagcaccgacuggauagaagccaaaacgaagaaagaaacgaucgccggcuacgucaaaaguuacgauaucuuugauggucgacuacuugucuacgcccacgacaacaagaaaguugugaggaaacucacgcucucggcccucgccgaccuacagaaacugcacguaucaauacuaggcgaccucuacaaaggaggcacacccaaauguagcccccucagaaaaggccaagaacuauga

SEQ ID NO: 7302 - RNA, 3186 nt, Artificial Sequence
  Cas9 variant
augcuccggcucggccuggacauaggaagcacauccauagggugguuccuauacagaauaaccaacgguaugauagccgaaaucauagacugcggcguccgccuauuuucugacggacgggacgcaaaaacaggcgucuccucggcaguagagagaagaaacgcacgagccuugcggcgccgucgagaccgauaccucaggcggagagcagcacuaaugcgacggcuugcagccgcgggucugaugcccgaagacccuucccaggcaaaaccacuagaacuacucgacccauaccgacucagagcagacgcccuagauagacgauuagaacucacagagcucggacgcgcacuguuccaccucaaccagagaagaggcuuuaaaagcaaccgccagacagaccgcgggaacaaugaaggaggcaaaaucaucgacggaucagccagacucgaccaggcaaugauggcagugggagccagaaccuacggcgaauuucuacaccuaaggagaagccaagcagaagaccucagaagagucccaagcguccggacccgccuuacacuccgcaguguggacggcggaaaggcagagaccggauacgacuucuacccagaccggagacaccuagaagaagaguucaacaaggugugggccgcacaagccgcgcaccacccaguucucacagacagucuccggcacgaaguguucgagacaaucuuuuuccaaaggccauuaaaagcccccgcgguaggacggugucucuucuuucccgagccacgacuaccccgggcccacccacucacccaacgcagagugcucuaugaaacagucaacgcacuacgaauacggacagaaagcggcgccgcagucccccuaggaaaagaacagcgggacaaagucauaaugcugcuggacggaaaagcgccaguaaaagcuaucgccagcgcaaaacuaucacuaaaagcaaucgcaaaacaccuaaaacuacgcgacggacaaacauucacguuagaaaaaggacgggacuacauagcgugcgaccccguuagggccucccuaucccacccagacagguucggcccaagguggagcguacuagaggcggaaguccaagccgaaauagucggccgaauccgcgacgacgacgacaccauggcgcuaguagaauggcuuaaacaaguccacggacuagacgacgcacacgcacgagcuaccgcagacgcaccacuacccgaaggcuacggacgccucggagaaaccgccacccgaaaauuacuggacugccuaaaggcagaaguacucaccuacucagaagccguaggaaaagcccuggaccaacaccacucagaucggcgaacgggggagauccucgaauccuuaccguacuauggcgagguccuccaagcacacgucaucccaggaacgggagagccgcaccacgacgauauaacccgguucggcagaaucaccaaccccaccguccacaucggccucaaccagcuccgccgacucgugaaccgcaucauagcaagguacggcaagccagcagaaaucgucguggagcuugccagagacuugaaacaaucaaccggacaaaagaaggccgccaucgccuuaaaccugaaaaacagaaaggcugcugaagcgagaucggcucuacuaacagaauggggcguaccagacaccggagcuaaccgaauguacguccgacuauggcaggaguuacacgaagacccaaugaugcguagaugcccauacacgggaacaauaaucagcccgucacuacucuucuccggugccaucgacauagaccacauccuaccauacagccgaacacuagacgauaguacagccaaccgaacccucugcaugaaagaggcaaaucggcaaaagcgcaacaaaucgcccagcgaggcccgaagagaugguaugcgcauaugggcccuggaagacgacaaccuacgucacaucccagaguucaaacgauggcgauucgccgaagacgcaauggcacgcuucgaaggcgaaagagacuuugaggccagagcccucgucgacacccaguaccucucacgcaucuccaaagcauaccuggaaacguuauacgacggggccgacggcaaaucccacgucuggguggucccaggccggcugaccgaaaugcuaagaagacacugggggcuaaacggcauacuaaccgacccgcucagagacgucacaaaggagaaaaacagaauggaccaccgacaccacgcaaucgacgcagccguagucgccgcuacugacagaggucuaauaaaagcgauggccgaacaagccaggacagacgucgaucaagggcgcgaagccuuagcaucgucaaucaugccacccuggccaggauucagagaagcaguagcagcccaaguggaccgaauaauaguaagccacagaccagaccacggaaggaucgaccucacaacucgaaugaaaggccgggaccaaaccacagggccacuacaccgggacaccgcauacgggcuaacaggccaaagcgaaaaagggguaccccuaguaguaacacgggaaccauuugacaaccugaccccaacuaugauagggaaaauacgagacgagccccuaaaagcugcccucgccgcagugacagcuggaaagaaagacgacgcauuugccgaagcacuagcacacuuucgggauagaccagguccauaccacggaauacgcagagugcggcucauagaaccaaucagcgucgucgaaauacgagacgccucuggccgcgcuuauaaagguuauaaaggcaacuccaaccacugcuucgaaguauggcgacuaccaggaggcgcaaucacagaacacaucguauccacauuugacgcgcaucaaccaggccccgaaccgcgaccccacccagcugcaaaacgacuacucagguuauucaaaagcgacaugguaaaacuagacgacaguaaauucgggcccgugauugcaaccgucguaauguucgaucgaaacggcaaaaucagccucgucccacauacagccagcaaugcacgaaagagaugcgaaaaguacaaggaagaccuguaccuaagguucaccgccaggacccuaauugaggcgggcgcccgcagaaucauagucgacgaaaccggacauuucagggaccccgggaggaagggauga

SEQ ID NO: 7303 - RNA, 3189 nt, Artificial Sequence
  Cas9 variant
auggccgaaaagcaacauagauggggccuggacauaggcacuaauucaauaggaugggcagucauagcucuaaucgaaggcaggccugccgggcucguagcgaccggcagccgcauauucucagauggccgcaacccaaaagacggaagcucacuugccguggaacgacgcggaccacgccagaugcgacgccggcgggaccgauaucuucgacgaagagaccgcuuuaugcaggcccucauaaacguaggccucaugccuggagaugcagcagccagaaaagcacucgugaccgagaacccauacguccugagacaacgaggacuagaccaagccuuaacgcuaccggaguucggcagagcacucuuccaccucaaucaacgacgcggauuccagucgaaccgaaaaacagaccgcgcaacagcgaaggaauccggcaaagucaagaacgccaucgcagcauuccgagcagggaugggaaacgcgcgaacugucggagaagcccuugcacgccgccuagaggacggaagaccugucagagcccgcauggugggacaagggaaagacgagcacuaugaacuguacaucgcacgcgaauggauagcccaagaguucgaugccuuaugggcuucacaacagcgauuccacgcggaaguccucgcggacgccgcacgcgacagacuccgcgcaauacuacuguuccaacgcaaacuacuccccguaccuguaggaaagugcuuccuagagccuaaccaaccaagagucgcagcagcgcuaccgagcgcccaacgcuuccgccucaugcaagaacuaaaucaccuccggguaaugacgcuagccgacaagcgagaaagaccccuaaguuuccaagagagaaacgaccuccucgcccagcuaguagcgcgaccgaaaugcggcuucgacauguuacggaaaauaguauucggggcaaacaaagaggcauaccgauucacaaucgagagcgaacgcagaaaagagcuaaaaggaugcgacaccgccgcgaaacuagcuaaaguaaacgcacuaggcacaagauggcaagcacuaaguuuagacgagcaagaccgccugguaugccuucuucucgacggagaaaacgaugcgguccucgccgacgcacuaagggagcacuacgggcugacagacgcacaaaucgacacccugcucggacugagcuucgaagacggacacaugcgccucggcaggucggcgcuccuccggguacuagacgccuuagaaagcggacgugacgagcaaggccugccccucuccuacgacaaagcaguaguggcagccggguacccggcacacacagcagaccucgagaacggcgaacgugacgcgcuaccguacuauggcgaacuacuguggcgcuacacccaagacgcgccaaccgccaaaaacgacgccgagaggaaauuuggcaaaauagcaaaccccaccguacacaucgggcuaaaccaacucagaaaacucgucaacgcacucauacaacgauacggaaaaccggcacaaaucguaguagagcuagccagaaaccucaaagccggccuagaggagaaagaacggauaaagaaacaacaaaccgcgaaccuagaacggaacgaaagaauaagacaaaaacuacaagacgcuggggucccagacaacagggaaaaccgccuaagaaugagacuauuugaagaacugggccaagggaacggccucggcaccccgugcaucuacucaggccgacaaauaagccuacaacgacuauucagcaacgacgugcaaguagaccauauacuacccuuuucgaaaacacuugacgauucauucgccaacaaaguacuagcgcagcaugacgcaaaccgcuacaaaggaaacagaggaccauucgaggcuuuuggagcaaaccgagacggauacgcuugggacgauauccgagccagagcggcaguauuaccaaggaauaaacgaaaucgauucgcagaaacagcaaugcaagacuggcugcacaacgaaacagacuuccuggccagacagcucaccgacacagcauacuugagccgcguggcgcgacaauaccuuacugcaauauguagcaaagacgaugucuacgugucacccgggcgacucaccgccaugcuacgggcaaaauggggacuaaauagaguccuagacggcgucauggaagaacaagggcgaccagcggucaaaaaccgcgacgaccaccgacaccacgccauagacgccguagucauaggagccacagacagagccaugcuccaacaaguagccacacuagccgcacgcgcacgcgaacaagacgcagaacgacucauaggagacaugccaaccccguggccaaacuuccuagaggacguacgcgcagcagucgcacgaugcguggucucccacaaacccgaccacggaccagagggcggccugcacaacgauacagccuauggcauaguagcagggcccuucgaggacggucgcuacagaguaaggcaccgcguaagccuguucgaucucaaaccaggagaccuaagcaacguccgaugcgacgcgccacuacaagccgaacucgaaccuaucuucgaacaggaugacgcccgcgcgagagaggucgcacucacagcgcucgccgaacguuaccgacagcgaaaaguguggcuagaagaacucaugagcguccuaccaauuagaccgcgcggcgaagacggcaaaacacuuccagacucagccccauacaaagcauacaaaggagacagcaacuacugcuacgaacuauucauaaacgaacgaggacgaugggacggugagcuaaucagcaccuuuagagccaaccaagccgcauaccgacgauuccgaaacgacccagccagauuccgccgauacacagcuggcggacgcccccuccucaugagacuaugcauaaacgacuacaucgcaguaggcacggcagcagaaagaacgauauucagggucguaaaaaugucagaaaacaagaucacacucgcagaacacuucgagggaggaacacucaaacaaagagacgccgacaaagacgacccauucaaauaccuaacuaagagccccggagcccuaagagaucuuggcgcaagacggaucuucgucgaccuaaucggcagaguccuagaccccggaaucaagggagauuga

SEQ ID NO: 7304 - RNA, 3189 nt, Artificial Sequence
  Cas9 variant
augaaccugaacuacauucugggccucgaccuggggaucgcaagcguugguugggccgucguagaaauagacgagcaagaaaauccacaacgcuugaucgacguaggagucagaacguucgaccgagcagaaguacucaagaccggggaaagccucgcauuagcacgccggcucgcccgcucaucacgacgccugguaaagcgcagagcggaacgaauaaagaaagccaaacgucuccuaaaagccgaaaaccuacuacuaagcgccgaugaaauacugcccaacgaagccuggcaacuccgcgucaaaggcuuagaccaaaaacuggagcgccaagaaugggcagccguccuccuccacuugcucaagcaccgaggcuacuugucacaaagaaagaaugaaucaaaaagugaaaacaaagaauuaggcgcccugcuaaguggaguagcaauaaaccaucaaauauugcaaucggccgaauaccgaacacccgccgagauagccguaaacaaauuccaggccgaggaaggccauauccgcaaccagcgcggcgcuuacacacacaccuucagccgacuagaccuacucgccgaaauggaacuccuguuccaacgccaggccacccuaggcaacccacacaccuccaccaaacugcuugaaaaccucacggcccuccucauguggcagaaacccgccuuagccggagaagcaauccugaaaaugcugggcaaaugcaccuucgagcccaccgaauacaaggcagcgaaaaacuccuacagcgcggaacgcuucguuuggcuaaccaaacuaaacaaccugcgcauauuggaacaaggugcggaaagagcacugacggacaacgaacgauucgcacuucuggaccagccauacgaaaaagcaaaacuaacuuacgcacaaguacgaacgcuccucggacuaucggacgaggcaauauucaagggacuccgcuaccaaggggaagacaagaaagccguagagacgaaaacaacgcuaauggaagucaaagcauaccaccaaaucagaaaagcacucgaaggccuagaccugaaagcagaguggaacgagcucaaaaacaacccggcacuacuagacgaaaucggcaccgcauucagccucuacaaaaccgacgacgacauccaccgauaccuugacggcaaauuaucugaaagcguccucaacgcgcuccucgaaaaccuaaacuucgacaaauucauccaacuaucacuuaaagcccuccaacagauacuaccccuuaugcuacaaggucaaagguacgacgaagcaguaagcgccauauauggagaccacuacggaaagaaaagcgacgagauagaucgacucuuaccgaacauaccaacagacgaaauacggaaccccguaguccuaagaacccuaacacaggcccggaaaguaauaaacgccguaguaaggcuauacggcucaccagcacgaauccacaucgagaccggcagggagguaggaaaaagcuaucaagaucgaaagaaacuagaaaaacagcaggaagagaaccgaaaacagcgcgagaacgccgucaagaaauucaaagaauauuuccccaacuucgucggggaacccaaaggaaaggacauacucaagaugaggcucuacgaacuacaacaagccaaaugucucuacuccgggaaaucacucgaacuauaccgacuacuugaaaaaggcuacguggaaguagaccacgcacucccauucagcaggaccugggaugacucguucaacaacaaagugcucguccuagccaacgaaaaccagaacaagggaaacgcaacacccuacgaaugguuagacggcaaaaacaacucagaaggcuggcaacacuucgucgcacgggugcaaaccagcggcuucuccuacgccaaaaagcaacgaguacucauacaagaacuggaugaaaagagcuucaucgaacggaaucugaacgacacgcgauaugucgcaagguuccucuguaaccacaucgcagacaacaugcuccucaccgggaaaggcaagaggaaaguauucgccagcaacggacaaaucacagcccugcuccguggcugcuggggacuccaaaagguccgagaaaacaaugaccggcaccacgcccucgacgccguugugguagcgugcucaaccaaaagcaugcaagacaaaaucaccaaguucguaaaauacaaagaaggcagacucuuuaaagacaagaaagacggaguauacaaaggagaaagaaucaaucgggaaacaggggaaaucauaagccuacacuuuccaacaccauggaaauucuucaaagaaaacgucgaaauacgcaucuucagcgaaaacccaaagcucgaacuugagaacagacuucccgacuacccacaguacaaccacgaguucguacaaccccuguuugugagccgcaugccgacgcgcaaaaugacaggccaaggacacauggagacgguaaaaagcgcgaaacgacuagauaaaggccucagcgucuuaaaagucccacuuacacagcuaaaacucucagaucuugaaagaauggucaaccgagaaagagagauggcccucuacgaagcauuaaaagaaugccucgaacaguucggaaacgacccagccaaagcauucgcggaacccuucuacaagaaaggcggagcacucguaaaggccguacgagucgagcaaacccaaaagucuggcguccucguacgcaacggcaacggcguagccgacaacgcaacaggaagcaucguuagaguugacguauuuaccaaaggcggaaaauacuuccuagugcccauauacacguggcaggucgcgaagggcauacugccaaacaaagccgugauccaaggcaaagacgaaucagaaugggaagagauggacgaaaacgccgucuuccaguucuccaugcacaaaaacgaucugaucaaggucaaaacgaagaaaggagaaaucuucggcuacuucaacggacuagaccgcgcaacaggcagcaucgagauugaagaacacgaucuggaaaaauccaaaggcaaaaauggcucccaucgcggccuaggaguaaaaacggccuucuuccuagagaaauaccaaguagacgaacuaggcaaaaacauacggccgugucgccccaccaaacggcagcacgugagguga

SEQ ID NO: 7305 - RNA, 3192 nt, Artificial Sequence
  Cas9 variant
auggagaaccacaucaacuaccgccugggccucgacaucgggaucgccagcgugggcuggucugucaucaaccuggacaagaagcggaucgaggaccugggggugcgcaucuucaacgccgcggagcaccccaaggacggcagcucccucgcccugccgcggcgcaucgcccgggggcgccggcgccugcuccggcgcaaggccuaccgggugaagcgcguccguaagcugaucguggacuacaacauccugaccaaagaccagcucaacgaucuguucaagcagaagugccagaauagcgugugggagauccgcgucaaggcccuggacaacaaggugaccaacgaggaaugggcucgguugcugauaaaccugugcaagcgccggggcuucaaguccaaccgcaagaacgaagccgacgacaaggagacaaagaaggugaucaacagcaucaagucgaacaucaagggcaugaaggagagcgggucccggacuaucggcgaguacaucuacacccaaacccucagcuccggggacaucagcaaguccuuuaggaacaaggacggccaguacaacaacugcgucagccggaagaugauagaggaggagaucaaaauccuguucaagaagcagcgcgagcuggggugcgaguucgccagugaggagaucgaggagaaguaccucgccaucuucaacagccagcgccccuucuccaaguucgaggaccuggagaagauggugggcuucugcacguucgagaaggcguccaaggagcggcgcgcccccaagugcaguaucagcgcggaggaauuugugcuguacgacaacaugaacaagcucagcauacugaacaagggcgacacccggaagcugaccaacgaggagcgcaagaucaucgucgagaacgccuucaagaacaaggagaucaaguacuccaagcuccggaagauccugaaccugagcaacgacgagcgcuucuccacccucagcuacuccaacaagacggagcucagcaagaccgagaacuccaaguucguggcccugaagggguaccacgagauuaagagcgcgaucgagaaguccuucggcaaggacaccuggaaccgggugaagaacaaccgcaccaugcuaaacgacaucgccuacguccugagcaucgccaagacggacgaggacaucaucaagcagcugucccuccggaacaucccccgcgagaucaucgacgccgugcuggggcugagcuucuccaaguucuccaaucucuccaucaaagccaucgagaagauccugccguaccugaaggacggccagcaguacaacgaggcgugcaagagcgccgguuacgacuucaaggccacuuacaacggggagaaguccuacaagcucccccugaucgauaucgacgagaucgugaaccccgucgugaaccgggcccugagccagacccgcaaggugaucaacgccgucaucgaccgguacggcucccccaucgggaucaacaucgagcucgcgagagaccuggccaagaacuucaaggaccggagcaagaucaagaaggagcaggaggagaaccgcgccaacaaggagaagaucaagaacgagcugaagaugcucaugaauaaggagccgaccagcuccgagauccugaaguaccggcuguggaaggagcagcgcgaggagugcgccuacucccaggagcggaucuacauugaggaccucuucaaggugggccaguacgagaucgaccacaucauccccuucucccgcagcuucgacgacucccugaacaacaaggugcuggucaaggccgcggagaaccagcgcaaggccaaccggaucccauacgaguacuucgggagcgacgaggaccgcugguaccgguucgaggugugggucgagcaguccagccuguccuucaagaagaagaacaaccuccugaagaagcgcuucagccgggaggacuccaucgaguucaaggaccgcaacuuaguggacacgcaguacauaagccgguacaucuccaacuucaucaagagccgccucauauucaaggaguccgacagcaagcagaaggugaucaccaucaacggccgggccaccuccuaccugcgcgcaaaguggggccugcucaagguacgggagaacggggacaagcaccacgcgcuggacgcaaccgugaucgccguggccacgcagggcaugguccaggagaucagcaaguacagcaaggcccacgagcugaaguacauccgccagggggacgaguucauagacaucgagaccggcgagaucgugaaggugaaggaccacaagcaccucuccaaggaccggcugcccgagccguggcugggguucagcuccgagcuccgccugcgucugagcgagaaccccaucgaggaacucaagaagucccccaucagcaccuacgacgaggaguuuauccgcaagaccguccggcccaucuucgugucacgcgugccguaccggaaggucacgggccgccuguucgaggagaccguguacagccccaaggcguucaucgacgagggcuucaucgccaagaagaaacuucaggaccucacccugaaggacuucgaaaacaucuacaacuacaacuccgacaagaagcuguacgacgcccuccgggagcgccuggaggaguacgggggcaacgccaagaaggccuucgcggaggaguuccgcaagcccaccaagacggggaagcugggccccaucgucaagagcaucaaggugaagaccaagaucccguucaaggacgggaucgaccucaacggcggcaaggugaagaaggacgggcuggugcggauagacauuuacgaaaaggagggcaaguacuacgucgugcccguguaccgccuggacauccagcaggggaacauccccaagaaggccgccgucgccaacaaggaggagaaggacuggauccucauggacgaguccuacaacuucaaguucagccuguacaagaacgaccugaucuacaucaaguacgacucaaagggcgaguacuucggcuacuacgacggguucgaccggcacaccggcgccaucacccucgagcgccacgacaacagcgagcgguaccgcgggaucggcaucaagacgggggugaaggagaucuucaaguacaacguggauguccugggccgguacuacaagguggcgaaguga

SEQ ID NO: 7306 - RNA, 3192 nt, Artificial Sequence
  Cas9 variant
auggagaaauuccacuacguacucggucucgaccucgggauagcguccguaggaugggccgccauagaaauugauaaagaaaccgagaccucaauaggccuccuagacugcgggguacgcaccuucgaacgagcagaagucccgaaaacaggugacagccuagcgaaagcacgccgagaagcccgcuccacuagacgccucauacgccgccgcagccaccgacugcuacgacugaaaagacuccuaaaaagagaaauauuccggcaaccagagaccuucaaagaccuacccaucaacgcauggcaacuccggguaaaaggacuagacucacgucuaaacgaauacgaaugggcugcagugcuacuacaucuagugaaacaccggggcuaccugagccaacgcaaaagcgagaugucggaaacagauagcaagagcgagaugggcagacuccuagccggggucgccgaaaaccaccagcuucugcaacaggaacaguacagaacacccgccgaguuagcccucaagaaauucguaaaacauuucaggaacaaagguggugacuaugcccacaccuucaaccgccuagaccuccaagcggaacuacaucuccuguuccaaaaacaaagagaacugggaaaccccuucaccucaccugaacucgagcggcaaguagacgaccuacuaaugacccaacgcucagcacuccagggggaugccauccugaaaaugcucggccacuguggcuuugaacccgagcaguucaaggcggccaaaaauaccuucuccgccgagcgauucauauggcugacaaaacuuaacaacuuacgcauccaagaccaaggcaaagaacgcgcccuaacagccgacgaaagaacaaaacuccuagacgagccuuacaagaaaagcaaacucaccuacgcccaaguacgaaagcuccugagcuuaccacaaaccgccauauucaaggggcucagguacgaccucgaacaugacaagaaagccgaaaacuccacacuaauggaaaugaaaucauaccacaacauccgccaaacgcuugaaaaaucgggccuaaagacggaauggcaauccaucgcgacacaaccagagauccuagacgcaauaggcaccgcguuuuccauauacaagacagacgaggacauaagucacgaauugaaaaccugccgccucccagagaacguccugaacgaguuacucaagaacauaaacuucgacggcuucauccaacucucgcuaaccgcccuacgcaaaauacucccccucauggaacaaggauaccgguacgacgaagcgugcacccaaauuuacggcaaccaccauucaggcucacuacagcaagagagcaaacaauuccucccgcacaucccuauagacgacguacgaaacccagucgucuucagaacccucacacaagcucggaaagucgucaaugccaucauacgccgcuacggaucgcccgcccguguccacauagagauggcaagggaauuaggcaagucaaaauccgaccgcgaccgcauagaaaaacagcagcagaaaaauaagaaagagcgugagaaugcgguagcaaaauuuaaggaagacuuucccgacuucguuggcgaaccccgaggcaaagacauacucaagaugcgacucuacgaacaacaacauggaaagugccucuacucaggacacgacaucgacaucaaucgacugaacgagaaggguuacguggagauagaccacgcacuaccguucuccagaaccugggacgacucccaaaacaacaagguccuaguacucggcagcgaaaaccagaacaagcgaaaccagacccccgacgaauaccucgacggagcaaacaacucccaacgguggcuggaguuucaagcgagaguacaaaccugccacuucagcuacgggaagaaacaacggauacagcuagcaaaauuagacgacgaaacagaaaaaggcuucuuagaaaggaaccuaaacgacacacguuacauagcccgcuucaugugccaauucguccaagaaaaccuauaccuaacagguaaaggcaagcgucuaguguucgcauccaacggaggaaugaccgcgacucuccgaaaccucuggggacuccgaaagguaagagaagauaacgacagacaccacgcacucgacgccauagucguagcaugcucaaccgcgagcaugcagcagaaaauuaccaaagccuuccaaagacacgagucaaucgaauacguggacaccgaaaccggcgaagucaaguuccgcaucccccaacccugggacuucuuccgucaagaaguaaugaucagaguguucuccgaccaacccugcgaagaccucguagaaaagcucucggccagaccagaagcccuccacgacaacguaacaccccucuucguaucacgagcccccaaccgcaaaauguccggccagggacaccuagaaaccauaaaaucagcuaagaggcuaagcgaggaaaacuccauggucaagaaaccacuaaccacccucaaacucaaagacauccccgaaaucguaggcuacccaagcagagaaccacaacucuacgcagcacuaaaaacccggcucgaaacacacgacgacgaccccauaaaagcauucgcgaagcccuucuacaaaccaaacaaaaacggcgaacuaggcgcacuuguacgaucuguuagggucaaaggcguacagaacacaggagucaugguccacgacggcaaggggaucgcugacaacgccacgaugguccgcguagacgucuacacaaaagccgggaaaaacuaucuaguaccaguauacguuuggcaagucgcucagggaauacuccccaaccgcgccguaacauccggaaaauccgaggcagacugggaccucauagaugaaucguucgaguucaaauucagccucagccggggugacuuaguagaaaugauuagcaacaaaggacgaauuuucggauacuacaacggccucgaccgggcgaacggaucaaucggcauacgagagcacgaccucgagaaauccaagggaaaagacgguguacacagagucggcguaaaaaccgcaacagccuucaacaaauaccacguggacccccuaggcaaggaaauccaccgcugcagcuccgagccuagaccaacccugaaaaucaaaucaaagaaauga

SEQ ID NO: 7307 - RNA, 3192 nt, Artificial Sequence; identical to SEQ ID NO: 1507
  Cas9 variant

SEQ ID NO: 7308 - RNA, 3195 nt, Artificial Sequence
  Cas9 variant
augagcgagugcgugacaagaagaauacucgggauugaucugggcauugcgucaugcggcuggggcguaaucgaagucggagaagcaagcgggagcaucaucgcauccggcguuaggugcuucgacgcaccacuaaucgacaaaacaggagaacccaaaagcgcgacaaggcgcacagcccgcggacaacgacgaauaaucagacgacgaaggcagaggaugaacgccgugaggcgccuacuagcagaguucggcguccuaacaggcagaucaccagacgcccugcaccaggcgcuccuaagacucagccaauccguagcaggaucacaagucacgccguggacccuacgcgcagcagcacaugaacgcaaauuaaccaacgacgaacucgccguuguacuaggacacaucgcgcgacaccgaggcuuccggagcaacucgaaaaacgacggcggcgccaaugcggccgacgaaaccuccaaaaugaaaaaggcaauggaaaccacccgcgaaggccuagcacgauaccacagcuucggagcgaugauagcauccgaccccaaauucgcagaucgaaaacgcaaccgcgacaaagauuacagucacaccgccaagcgcuccgaccuagaagacgaaguacgcacgauauuucgaucacaaaccagauuuggcagcuuaguggccucagaaaagcuaucccaagcguucgcugacgcggcguucuuccaacggccccuacaagacagugaagacauggucggaagcuguccguucgaacccgggcagaaacgcacggcaaggagagcaccgagcuucgagcuguuccgauuccugagccggcuagccaaccuaaaacuaacaguaggcagagccccagagcgacgacugacacccgaugaaaucgccuuagcagcaaaaggguucggcgaaaccaagaaaagcauaacauucaaaucccuacgagaagcacuagaccuagaccccaacgccagguucagugggguagcaaaagaaaaagagucaacacucgacgucgcggcgcguaccggcggcgcugccuacggcacuaaaacacuaaaggacgcucucggagacgcgccauggagaucgcugucaaggaugccagaaaaacuagaccgcauagcagaaauucuuucguuccgagaggacaugaaagcaauacgcaacggccucgaggaagucggacucgauggccuagugguagacgcgcuaaugcaagcgaccgccaacggagacuucaaagacuucacccgagcggcacacaucagugcccucgcggccagaaacauaauaccaggacugcgagaaggacugguguacagcgacgccugcaccagaguaggauacgaccacgcagcacgaccagcagucccccuaagccaaauaggcucccccgucacgcgaaaagcccucucggaggcgcuaaaacaaguaagagcaguagcacgagaauacggaccaauagacuacuuucacauagaauuagcacgaagcaucggcaaaagcgcugaggaaagaaagaaacucacggacggcauagaggcaaggaacguggaaaaagaaaaacgaaggaaagaggcagcugaacaccucggaagggcacccagcgacgacgaguuacucagauacgaacuagccaaggaacaaaacuuuaagugcauauacagcggagacccaauagacccagccgggauaagcgcaaacgacacccgcuaccaagucgaccacauacugccauggagcagauucggcgacgacagcuacguaaacaaaacccucugcacagcaagaagcaaccaaaacaaacgagggcgcaccccauucgaaugguucgacgccgacaaaacagaagccgaauggauggaauacagcgcaagaguggaggaccucaaggaggucaaaggacggaagaaacgaaacuacagcauaaaagacgcagcaagcguagaagacaaauucaaagccagaaaccucacugauacccaaugggcgacucgccuccucgcagacgaacugaaacgcauguucccgcccagagaaugcgagcgcguuguaacaguacgcgcagauggcggcaacgauggccuaagcauaguagaagaaagacgcgucuucaccagaccaggagcgauuacaagcaaacuccgccgagcauggggccuagagggacucaagaaacaagacggaaaacgaguugaagacgaccgacaccaugcggucgacgcucuaguauuagcagcaacaacagagagccuacuaaauagacucaccgucgagguacaacaacgugaacgggaaggaagacaagaugacauauuccacuguagccagccauggccgggauuccgggucgacguacaaaggaccguauacgggagcgaaaccaugcccggcaucuuugugagcagagcggaacgacgcagagcccgcgguaaagcacacgacgcaacagugaaacaaauacgggacauagacggggaacggauaguguucgaacgcaaacccaucgagaagcuaacagacaaagaccucgagcgcauacccguacccgaaccauacggaaaggccgccgaccccaagaaacuacgagacgaacucguagaaaaccuacgagcauggaucgccgcgggcaaaccgaaagacaaaccgcccagaucccccaaaggagauaucauaagaaaaguccggauugaaaccaaagacaaaguagcagucgagaucaacggaggaaccgucgauaggggagauauggcaagaguagacguuuuccgcaagaaaaacaagaaaggcgugugggaguucuacguaauacccaucuacccgcaccaaauaguagcaucagcccuaccgccaaaccgcgcggucauagccuacaaagccgaaucugaauggaccgcgaucgacgggugcuucgaauuugcauggagccuaaacccuaugagcuaucucgaacucguaaaaucaaacggugagcucauagaaggauacuuccgcucaauggaccgaacaaccggugccaucaaccucaguccuaugagcacaaacagcgaaacaauacgcagcauaggggucaaaacgcugagcagcuucagaaaauucacaguagaucgccugggcagaaaauucgagauaccccgcgaaguccgaaccuggagaggggaagccugcaccuga

SEQ ID NO: 7309 - RNA, 3195 nt, Artificial Sequence
  Cas9 variant
augaaaaggacaagccuccgagcauaucgccucggagucgaccuuggagccaacagucucggaugguucguaguauggcucgacgaccaugggcaacccgaaggacuugggcccgguggcguacgaauauucccggacgguaggaacccgcagagcaaacaaagcaacgccgcaggccgccgacuagcccgcucagcccggcggagaagagacagauaccugcaaagacgaggaaaacuaaugggacuccuaguaaaacacggacuaaugccggccgacgaacccgcucgaaagcgccuagaaugccuugacccauacggacuaagagccaaagcccuggacgaaguccugccacuccaccacguaggcagagcacucuuccaucuaaaccaaagacggggacucuucgcaaauagagccaucgaacagggcgacaaagacgccagcgcgauaaaggccgccgcaggacgccuacaaacaucaaugcaagcgugcggagcaagaacacuaggagaguuccugaacagacgccaccaacuacgugcuacggucagagcaagaagcccagucggaggcgacguacaagcaagguacgaguucuacccaacgcgcgcaaugguagacgcagaguucgaagcaauaugggccgcacaggcgccacaccacccgacaaugaccgcggaagcacacgacacuauacgagaggcaauauucagccaaagagcaaugaagagaccgucuauaggcaaaugcucccucgacccagcaaccucacaggacgacgucgacggcuuccguugcgcauggucccauccauuggcacaaagauuccgcauauggcaggacguccgaaaccuagccgucgucgagaccggcccuacgucaagucgacuagggaaagaagaccaagacaagguagccagggcucuccuacaaaccgaccagcucagcuucgacgaaauuagaggccugcugggacuaccuuccgacgcuagguucaaccuagaaagcgaccgcagggaccaccugaagggagaugcaaccggggcuauacucucagcacgcagacacuuuggacccgccuggcacgacagaucccucgaccgccaaauagacaucguggcacuacucgaaagcgcacucgacgaagccgcaaucaucgcaucguuaggcacaacgcacucacuggacgaagcagccgcccaaagagcacuaagcgcauuacuccccgacggcuacugcagacugggacugagggcaauaaaacguguccuaccccuuauggaagcuggaaggaccuacgcagaagcagcauccgccgcuggauacgaccacgcgcuccuacccggaggcaaacuauccccaaccggcuaucuacccuacuacggccaguggcuccagaacgacguagugggaucugacgacgaacgcgacaccaacgagcgacgauggggacgacucccaaacccaaccguccacauaggaaucggccaacugagacgggucguaaacgaacuaauccgguggcacggcccaccagccgagaucacgguggaacugaccagggaccucaaacuaucaccacgacgacucgccgaacuagaaagagagcaagcagaaaaccaaagaaagaacgauaaacgcaccucccuccugagaaaacuaggccuacccgcauccacucacaaccuacuaaaacuacgacuaugggacgaacaaggagacgucgcuuccgagugcccauauacaggagaagcaauaggacucgagcgccucguaucagacgacgucgacauagaccacuuaauacccuucucaaucucaugggacgacucagcugccaauaaaguggugugcaugcgauacgcgaacagagagaaaggcaacagaacccccuuugaagccuucggccaccggcaaggccgccccuacgacugggcagacaucgcagaacgcgcagcgcgacuaccucguggcaaaagauggcgauucggccccggagcaagagcccaauuugaagaacuaggcgacuuccaagcgcguuuacuaaacgaaaccucauggcuggcacggguagcgaaacaguaccuagcggccguaacgcacccacaccgaauacacguacuuccaggacgccucaccgcccugcuuagagcaacaugggaacucaacgaccugcucccuggcuccgacgaccgggcagccaaaucaaggaaagaucaccgacaccacgccauagacgcgcuaguagcagcacuaacggaccaagcgcuguuacggcgcauggccaacgcccacgacgacacccgccgaaaaaucgaaguacuccugccauggccgacguuccgcaucgaccucgagacaagacuaaaggccaugcuagucucacauaaaccagaccauggacuacaagcaagacuacacgaagacacagcauauggaacggucgaacacccggaaacagaagacggcgccaaccucguauauagaaaaacauuugucgacauaucggagaaggagaucgauagaauuagagacagaagacugcgggaccuaguacgagcacacguggcaggcgaacgucagcaggguaaaacccuuaaggcagcuguauuaucauucgcccaacgaagagauauagccggccauccaaacggaauacgccacgucagacuaaccaaaagcaucaaaccagacuaccucguccccauacgagacaaagccggaaggauauacaaaucauacaaugcgggcgaaaacgcauuugucgacauacuucaagccgaaucgggcagauggaucgcacgcgcuaccacaguauuccaagccaaccaggccaacgaaucacacgacgccccagcugcgcaaccaaucaugagaguauuuaagggcgacaugcuccgaauagaccacgcaggggcggaaaaauuuguaaagaucguccggcuaucacccagcaacaaccuacuauaccucguggaacaccaucaggccggaguauuccaaacaaggcacgacgacccagaagacagcuuccgauggcucuuugcgagcuucgauaagcuaagagaauggaacgccgaacucguaagaauagacacacuaggccagcccuggcgaagaaagcgaggccuagaaaccggcucagaagacgcaacccgaaucggcuggacccgcccaaagaaauggccauga

SEQ ID NO: 7310 - RNA, 3198 nt, Artificial Sequence
  Cas9 variant
augaauaaggacaucaacuacgcccugggcuuagacauagggaucaccagcguggggugggccgucaucaaccuggaucugaaccgcaucgaggaccucgggguccggauauuuaaugcggccgaaaaccugaaggacggcucaagccuagcccucccacgccggcuggcccgcgggcggcgccggcuguugcgccggaaggccuaccgcguggagcgaguccgcaagcucauacugaagaacaacauccucaccaaggaggagcuggagggccuguuuaagaacaaggaggugaucgacgugugggaggcgagggucaaaggccucgacuacaagcugucccgcgaggagugggccaagauccucaucaacuucugcaagcggcgcggguucaagagcaaccggaagaacgaggccaaagacaaggaagccggucagauccuguccagcaucagcuacaauaucgagaagaugaaggagacgaacagccggacaaucggggaguacaucuauaacgaagugaagaacuccgaggacagcuacgcgccgcugcggaacaaguucggcgaguacaagaugugcguuucccgcgacgugauacgggaggagauccacacacuguucgagaagcagagggaacucgggaacaacuucgcuagcgacgagaucgaggacaaguacuucgagaucuucaacucccagcgccccuucagcaacuucgaggaccuggagaagcugguggguuucugcaccuucgagagaaagaagcacaaacgcgcccccaagcacugcaucuccagcgaggaguucacgcucuacgagggcaucaacaagcuguccaucauaaaggacggggagaagcggaagcugagcgaggaagaacgcacccucguggucaacgaggccuucaauaagaaggagauaaaauacaccacccugcggaagcuccucggcuuauccgaggaggaacuguucagcacgcucaccuacagcaucgacaaggacaucuccaagaccgagaacaccaaguucgugagccugaagggguaccacgagaucaagcgcgcgaucgagaaggggguguccaagaaggcguggcaggacaucgagaauaaccggaaccugcucaacgacaucgccuacguccugacgcugggcaagaccgacgacgagaucgagaagcagcuccgccugcggaacgugccagaggagcuguucgagagccuccuggacauguccuucaacaaguucaacaaccugagcaucuacgccuuggagaagauccugccguucaugaaggagggguaucaguacaacgaggcaugcgagaaggccggauacaacuucaaggcgaucuacgagggggugcgcaccaagaagcugcccgucaucgagaucgacgagaucgugaaccccguggucaaccgggcccucgcccagacccgcaaggugaucaacuccgugauagacaaguacggcagccccgucaggaucaacaucgaguuggcccgcgaccuggccaagaacuucaaggaccggaagcugaucgagaaggagcagaaggagaaccgcgcgaaccucgacaagauccgggagaaccugcgcgagcugauggacaaggaaccgacgguggucgagguccucaaguaccggcugugggagcagcagcgcggcgagugcgccuacacccagucccagauaccccuggagcgccucuucagccccgguuacugcgagaucgaccauaucauccccuucucccggagcuucgacgacucccugagcaacaagauucugguguuaggcucagaaaaccagagaaaggggaaucggaccccuuacgaguacuucggcgaggacagcgaacgcuggaacuccuuugagaucugggucaaggggagcuaccugaacuacaagaaaaaggccaaccugcucaagaagaaguucuccgaggaggagcagcgggacuggaaggcccgcaaccugcaggacaccaaguacaucugccgguacaucagcaacuucgugaacaaccgccuggaguucaaggagagcgaaaacaagcagaaggucaucacggucaacggccgggccaccgcguaccuccgcucgcggugggggcugaacaaagugcgcgaggacggcgacaagcaccacgcccuggacgccgccguggucggcgugaccacccaggggauggugcagaagauuagcaaguacuccaaggcccacgagcucuacacgguccggaagaacgacgaguucguggacgucgagaccggcgagugcgucgacguggacgaguacaaggagauccguaaggacauccucccccggccuuggcgcggguucagcgaggagcugaagcuccggcuguccgacaacccccuggaggagcucaagaaguccccgaucgagaccuacaacgaggaguucaucaaggagaacgugaagcccaucuucguuucaagggugcccuuccggaagaucagcggcaaacuuuucaaggagacuaucuacagcgagcgcgccuucaaggacggauacuucgugagcaagaaguccuuaguugaccucaagcggggcgaccuggacaacuucuacaacuacgagugcgacaagaaguuauacgacgccaucagcgaacgcaugaaggaguucaacuacaacggcaagaaggccuucgagucccccuuccgcaagccgaccaagagugggaaagagggccccguggugcgguccguaaagaucaagagcgccgugcccuucaaggacgggauccccaugaacgagggccucguggcgaaggagggcaugguccgcaucgacaucuacgagaaggaggggaaguacuucguagugccggucuaccgguaccaacuggccaaaggcaucgugcccaagcgcgccgccaucgccaagaaggacgagcugaaguggcccauaauggaccagaccuacaacuucaaguucuccaucuauaagaacgaccucauagaggucaaauacgacaagaagggggucuacuucggcuacuaugacggguucgaccggaacagcgcgagccugaccaucgagaagcacgacaacuccgagcgcuaccggucaaucggccugaaggugggcgugcucgagaucaacaaguacgaggucgacguacuagggaacuaccacaaggugaaacugggcgggaacuga

SEQ ID NO: 7311 - RNA, 3198 nt, Artificial Sequence
  Cas9 variant
augaacaaggacaucaacuacgcccugggacuugacaucgggaucaccagcguuggcugggccgucaucaaucuggaccugaaccgcaucgaggaccucgggguacgaaucuucaacgcggccgagaaccccaaagacggcuccagccuggcccugccgcgccgguuagcccgcgggcggcgccggcugcugcgccggaaggcauacaggguggagcggguccgcaagcucaucgugaagaacaacauccugaccaaagaggagcuggagggccuauucaagaauaaggaggugaucgacguuugggaggcgcgggugaagggccuggacuacaagcugagccgagaggagugggccaagauccucaucaacuuuuguaagcggcgaggguucaagagcaaccggaagaacgagacgaaggacaaagaagccggucagaucuuauccagcaucucguauaacaucgagaagaugaaggagaccaacagccguaccaucggggaguacaucuacaaugaggugaagaacuccgacgacagcuacgcgccccugcggaacaaguucggcgaauacaagaugugcgugucccgcgacgugcuccgggaggagauccauacccuauucgagaagcagagagagcuggggaacaacuucgccagcgacgagaucgaggacaaguacuucgagaucuucaacucccagcgccccuucagcaacuucgaggacuuggagaagcuggugggcuucugcacguucgagcguaagaagcauaagcgcgcccccaagcacugcauuuccucagaagaguucacccuguacgagggcaucaacaagcucuccaucaucaaggacggggagaaacggaagcugagcgaggaggagcgcacccuggucgucaacgaagccuucaacaagaaggagaucaaguacaccacgcuccggaaacugcugggccucuccgaggacgagcuguucagcacacucaccuacagcaucgacaaggacaucuccaaaaccgagaacacgaaguucgucucgcucaagggguaccacgagauuaagcgcgcgaucgagaagggcgucaguaagaaggcauggcaggacaucgagaacaaccgcaaucugcugaacgacaucgcguacgugcucacccugggcaagaccgaugacgagaucgagaagcagcugcgccuccggaacgugccggaggaguuguucgagagccugcucgacauguccuucagcaaguucaacaaccucuccauuuacgcccuggagaagauccuccccuucaugaaggagggguaccaguacaacgaggccugcgagaaggccggcuacaacuucaaggccaucuacgaggggguccgcaccaagaagcugcccgugaucgagaucgacgagaucgugaaccccgucgucaaccgggcgcuggcccaaacgcgcaaggugaucaacagcgucaucgacaaauacgguucaccggugcggaucaacaucgagcucgcccgcgaccuggccaaaaacuucaaggaccggaagcugaucgagaaggagcagaaggagaaccgcgccaaccuagacaagauccgcgagaaccuccgcgaacugauggacaaggagcccaccgcggucgaggugcugaaauaccggcucugggagcagcagcgcggggagugugccuacacccagagccagaucgcccuggagcgccuguucucccccggauacugcgagaucgaccacauuauccccuucagccgguccuucgacgacucgcucuccaacaagauccuggugcugggcagcgagaaccagcgcaaggggaacaaaaucccguacgaguacuucggcgaggacuccgagcgguggaauagcuucgagaucugggucaagggguccuaccucaacuacaagaagaaggccaaccugcuaaagaagaaguucaccgaggaggagcagcgcgacuggaaggcccggaaccuccaggacacgaaguacauaugccgcuacaucagcaacuuugugaacaaccggcuggaguucaaagaaagcgagaacaagcagaaggugaucacggucaacggcagagcgaccgccuaccugcggucccgaugggggcucaacaaggugcgggaggacggggacaagcaucacgcccuggacgccgcgguggucggcgugaccacacagggaauggugcagaagaucucaaaauacuccaaggcccacgagcuguauaccguacgcaagaacgacgaguucguggacguggagaccggcgagugcguugacguggacgaguacaaggagauuaggaaggacauccucccccgccccuggcggggcuucagcgaggagcugaagcugcgccucuccgacaacccccuggaggagcugaagaagcucccgaucgagaccuacaacgaggaguucauaaaagagaacgucaagccaaucuucgucucgcgggugcccuuccgcaagaucuccgguaagcuguucaaggagacgaucuacagcgaacgggccuucaaggacggguauuucgugagcaagaagucccuggucgaccucaagcgcggcgaccuggacaacuucuacaacuacgagugcgauaagaagcuguacgacgccauaagcgagcguaugaaggaguucaacuacaacggcaagaaggccuucgagagccccuuccgcaagccgaccaaguccgggaaggagggucccguggugcgcagcgucaagaucaaguccgcggccccauucaaggaugggaucccuaugaacgagggccucguggccaaggaaggcauggugcggaucgacaucuacgagaaggaggggaaguacuucgucgugccgguguaccgcuaccagcuggccaagggcaucguccccaagcgggccgcgaucgccggcaagagcgagcugaaguggcccaucauggaccagaccuacaacuuuaaguucuccaucuuuaagaacgauuuaaucgagauuaaguacgccaagaaggacggguacuucggguacuacgacggcuucgaccgccacaccgcgagccuggugaucgagaaccacgacaacagcgaccgguaccgcggcaucggggugaagacgggcgucgucgaguucaacaaguacgagguggacguccuggggaacuaccacaaggugaaccucggcgggaauuga

SEQ ID NO: 7312 - RNA, 3201 nt, Artificial Sequence
  Cas9 variant
augagugagaggguagugagaagaaucuuagggauagaccuugggauagcaagcugcggauggggaguggucgacaucagcggggcgggaggagggaucaucgccacgggaguacggugcuucgacgcaccccugauagauaaaaccggcgagccaaaaagcgcaaccagacgaacggcacggggccaaagacguauaguacgaagacgccgacaacgaaugaacgggguaagaaggcuucuaugcgaguucggccuucugcccgacccgaggccagaugcgcucaaccaagccaugcgaaggauaucaacagcuagcgccgccgcgcaagugacgccauggacacuacgggccgccgcccaucagaggcugcugagcaacgaagaacuugccguaguauuagggcacauagcccgacaccggggauucagaagcaacgcgaaaaacgaagcgggagcgaacgcagccgacgaaacgagcaagaugaagaaggcaauggaagcaacacgcgaagggcuagccaaguaccacgcauucggagauaugauagcaaaugacccuaaguucgcgaacagaaaaagaaacagagacaaagacuacucacacacagccaagcgcucagaccuagaggacgaaguaagagcaauacuaagggcacagcuaagauucggaucagcggcagccacggaaacgcuagcacaaacuuucgcagacgucgcauuuuuccagcgaccgcuacaagacagcgaagacagagucggcgacugcccauuugagccagggcagaaaagagcagcaagaagggccccgucguucgagcuguucagauuccugucgagacuggccaaccugaaacucgcaguaggccgaucgccagaaagacggcucacagcagaagaaauagcccuagccgccaaaggguuuggcgagaccaagaaaaccauuaccuuuaaaucccugcgcgaggcccuagaucuagacccaaacgcgagauucagcgggaucgggaaagacaaagaggccagcuuagacgucgucgcacgaacaggaggagcggcauacggaacaaagacccucaaagaugcacugggagacgcaccguggaggucauugagccgaacaccagaaacacuagauagaauagcagaaauacucagcuucagagaagacauaacaaguauaaggaacggacuagaagaccugggcuuggacucgcugguaguagaggcgcuaaugcaggcggcagccaacggcgacuucaaggaguucacucgagcagggcacauaagcgcccgagcagcacgaaacauaaucccggggcugcgagaagggcuagucuacagcgaagcgugcgcacgugugggcuacgaccacgcggcgagacugagcguaccgcucgaucaagugggaagcccaguuaccagaaaagcacugagcgaagcacucaaacaaguaagggcaguagcacgggaauacgggccgaucgauuacuuucauauugagcucgccaggucgguaggaaaaucagccgaagaaagaaagcaacucacggacgggauagaagcgcgaaacguggaaaaggcgaagcgaaggaagcaagccgaagaacaccucgggcgagcgcccucggacgacgaacuacuacgguacgaacucgccaaagagcagaauuucaaauguauauacucaggggacgcgaucgacccggcagggguagccgccaaugacacaagauaccaaguggaccauauacugccauggagccgauucggagacgauaguuaucugaacaaaacacuuugcacagcgcgauccaaccaaaacaaacgcggacgaacaccuuucgaaugguucgaagcggauaaaacggacguagaauggauggaguacguggccagaguggagaauuugcaggaaguaaaaggccggaagaaaagaaacuacucaauaaaagacgcagcagccauagaagacaaauucaaagcgagaaaccugacagacacgcagugggcaacgagacuacuagcggacgaacuaagcagaauguuuccgccaagagagugcgaacgagcgaucugcgguagagcagacggcggaaacgacggccuaacgauaguggaagaaaggaggguauucacgagaccgggcgcgauaacgagcaaacuaagacgagccuggggacuggaaggccugaagaaacaagacgggaaaaggguggaagacgacaggcaccacgcaguagacgcccuaguccuagcagcaacgaccgaaagccuccuacagcgacugacagucgagguacaaagacgggagagggagggcaggcccgacgacaucuuccacugcgcagagccguggagaggcuuucgggcggacguaaggcgaacaguguauggaagcgaaacaaugccuggcauauucguauccagagcagaaaggaggcgcgccagaggaaaagcccacgacgcgaccauaaaacaaaucagagaaaucgagggggaacggcuaguauucgagagaaagccgguggaaaagcuaacggacaaagaccuagagaaaaucccaauuccaaaaccauacggacaaguuucagacccaaaacggcuacgagacgaauuaguagaaagccuacgcgcauggauagcggcaggcaagccgaaagaccgaccgccccuaagucccaaaggcgacguaauccgcaaagucaggauacagacaaacgauaagguuucaguggaaauaaacgggggcacaguggaccggggcgacauggcucgagucgacguguucagaaagaaaaacaagaaagcggucugggaauacuacguaguaccgauauacccacaucaaauaguagcgcugaaugacccaccagacagggcgguaauagccuaugcagaagacaaagacuggaaagaaauagacaguagcuacgaguuccucuggagucucuuuggacuaagcuacguugaaauuagcaaagcaaacggcgaauguauagacggguacuucaggggccuccaccgagggacaggggcagcauccguaugcaaacacauaucacugggcaaagacgcgacagugucggggauaggguuaaaaacacuagccagcuucaagaaauucacaaucgaccggcuagggcgcaaauucgagauaccacgggagguaagaacguggcgcggggaagccugcaccuga

SEQ ID NO: 7313 - RNA, 3201 nt, Artificial Sequence
  Cas9 variant
augucucacuugguacuaggccucgaucucggccccaauagcauaggaugggcgcuagucaacgaugacccagaacacccggucgagagcaaacucguagaccuaggcguccgaguauuccccgaagggguggacaacuucgacacgucaaaggaacuaagccgaaacgaagacagacgcguagccagaggaaugagaagacaaauccgccggcgcgcaagacgaagacagcaauuaaaacaagcgcuaauagacagcaaacucuggccauccgaccccaacgacgaaguggucuuauacaacaccaaccccuacgaacuucgagcccgagcccugaaggagcgacucgaaccccacgaaguuggccgaguccugcuccaccuaaaccaaagaagaggauuccuaucaaaccgaaagaaagaccgcggggacaaagagguacaaggaaugcuagccgaaauaaacgaaaacgaacaacagugcaaagauggaggcuucgauacuaucggagcuuggcuagcugacaaacaggccaacaucgaccacgcuaacagagaggaaaacgaccacgugcggaaccgccaccuagcacggucacaauacguggaugaguucgaagccaucuggagcguccaagccaaacaccaucccaaacugcuaaccgaagaacuaaaagucggaaaacuaggaaagcagaccuauccaguaaaaccaaucccacgguggcacgaacaccgacaaggauugucaccccuagaaucauucggcaucuauggccuaauuuucuuucaaagaccaauguacuggccgaaaagcgucgucggccuaugcgaacuagaacccaaagaacgucgaugccaacgcucugacaggagacaacaaagguuuagacugcuacaggagguaaacaacuugaaauauguagacccggacacccaucucgaacaaaaacuugacgacaagcagcgacgccuucucuuagacaaacuaucgcacacaaaagagaugaccuucgaccaaauacgcaaagcacucgacuucuuagagagugucaaauucaaccucgaacgaggagaacgaucacgacucaaaggcgucccaauagacgcacuguucgcagcgaaggacguacuuggccaagagugguacgacagacccgagcaacagaaaacagaaauaguugcgguccuccuggacaacgagcgagacgacgaucgaaucaucgcacgagcgguagcagaaugggggaugaccgccaaggaagccgaagccaugcucgggguggaccuaccggcaggauacgccaaccugagcugcaaagccaucgaaaagcugcuaccccacauggaaaggggcuuacuauacauggacgacgaugaaagcaacagcgcaaugcacgcagcaggauaccucagaagagaccaacuucgacgccguauauucgacguacucccggacccggcaaggacccccaauugccccauaggagacaucccaaaccccgucguaaaacgcacgcucacagaaauccggaaaguagucaaugccauaguccgcgaauacggcaagccagacgccauacaccuagaacuagcacgaagcguacaaauggggaaggaaaagcgcuccgaauacagcaaaaugauccgcgaccgcgaagccgaacgcgacgggaucgucgaaaaacugagagagagcggaguacgagucacacgcgacaacauacucaaguaccaacugugggaacagcaaaaucaggaaugcauauacucaggcaaaccaauuagcuuugaaaagcuauucggcgagggcggaggcguagaaguggaccacauccucccaagaagcagaagucucgacgacagccaggcgaacaaaauaguaugccuccguaccgcuaacgcaggcaaaggggaccaaacccccuacgaguggcuagcagauacacagccgaaacaguacgaacaagucugccaacgagccgggaugcucaugagaucaggaagaaugcccuacgccaaauaucgcagguucauccagcgggaacuggaacuagacaaguucaucgcacgucaacuagccgacaccggauacauuacaaaagccaccauggaauaccuacgauaccuauucgacaaagaccacgacguacuaggccuaaagggacaacuuacggccgagcuacgauaccauuggggccuagagaccauccuagaagaacuacccgacagcccagcauggcacgaagcagacucaggaaaacuccgaccaggugagaaaaaccgugcugaccaccgccaucacgcaauagacgccguggucaucgcgcuaaccaaccgaaggcgccugguccagcucuccgacauuguaaagcgcggcggcgcccgagcacacggagaaauucuagaagacccauggccaaacuuucgcgaaaacgugguacaagcaaucaagaaaaccaacguaucacaccgaguagaacgaaaagucgcgggcaaacuacacgaggaaacgcuauacgggccaacgagaacaccaggggaauggguccuaagaaaacccgucauugcacucuccgcaaacgaaguagaacgaauccgggacgcaaccaucagacaaaucgugguuagcgcccuugcggacgccgggaucgacguaggccggggcaaaaagcccgacgccaaaaagaugaaggaggcauuaagcaaacuaaaaaugccaagcggaguucccauaagaaaaguacgacuaaccaaacccgaacaaacgauccaacccgugcgagccggacgaccggaccaggcauucguaaaacccggauccacacaccaccugugcauauucgaguucacggaaaacggaaaaacaaaacgggacgccguauucgugaccaugcuagaagcgaugaacagacuaaaacgccgggaaccgguaauccaacggacacacccggaacggccagacucccgcuucgucaugagccuaucggcccgagaaaugcugcuagcgaacuggaaagacggcgaacgacuccuaaccuucaagaccgccagcaguacgcaaggacaaauaugguucgcagagcacaccgacgccagaaaaucagccgacuacaaacaguuuguagcgaacgcgaauaccuuagacgcuaagaaagucacaguagacccgcucggucguauacgaugggccaaugacuga

SEQ ID NO: 7314 - RNA, 3204 nt, Artificial Sequence
  Cas9 variant
augggaacacgauuaggcuuagauaucggaacaaacucaaucggauggugccuauucaaccucgacggauccggccgacccauaggcauacgagacauaggagucagaaucuucagcgacggacgggacccccgcagcggcgcgucuuuagcagucgagcgacggguggcccgcgcuaugcgacgacggagagacagguauaucagacgccgcagcgcccuccuagaagcccucauaaauacagggcucaugccggcagacgugcaggagagcaaggcgcuaacaggaugcgauccauauguccuucgcgcccaagcacuagaccgggccuuagacgcgcaucugcuaggcagaguucucuuccacuuaaaccaacgacgcggauucaaguccaaccgaaaggcggaaagaaaagccggagacgacaaagaaggaggaaaaauagcagauggagcaaaagcucuagacuuagccaugcacgaagccggugcccgaacauacggcgaguuccuagcuggccgagacucacgccgaguccgauuacgcgcagaaggagacggauacgacuucuacccagaacgccgacaccucgaagccgaguucgacgccaucugggacgcccaagccgcuuacaaucccgcacuucucacggacgucguccgggaucgccucaggcgcaucaucuucuuccaacgaccacucaaagccccgaagguaggaggaugcacauucuucaacgaggagccaaggcucccaaaggcccacccacuuuuucaagaacggcgccuguacgaagaagucaaccagcucgaaauaacgcgggcaggcgcacccagucggaaacuaacacucgaccaacgagacaaaauuauaagaaaacuaaaaagcgcaaagacggcgagcuucucaggccuagcaagauuacugaaacuagcggacggagaaucauucuccaggguaacggaaaacagaacaggccucgccggggacgacaucuucacaaguuucagcgacaagcgcugcuucggagaccgcugggcacacuucgacccaggcguacaauggucgauaaucgaaacuguaacagaagaagaagacccggugaggcuacgagauuggcuaauggcgacccacggcgucaccguagagcaggcagaagcaauuggaagaguaagacuacccgagggacacggacgccucggcgaaacagcaagccgccucauccuagcacaacuaaaaagcgggagcaaagacggacacccccuaaccuacaacgaggccguagaagcagcacuaggcaagagucacagcgacuuccgcacaggagagauccuagaacaacuaccauacuauggagagauacuuucucgagaaaucccaccaggaucacuagacccagacgacgacgacgaaauacgguggggaaaaaucacgaaccccaccguccacaucggcuuaaaccaacucagacgacuacuaaacgcccuaauaaaagcucacggacgcccagacgaaauuguagucgaacuagcccgggaacuaaaacucucugagaaagacaaagcggaacacaacagacgcaucggagccaacacacgcgcugcagaagcacgaucgaaaaagcuccucgaaagcggccaaccagacacaggggcuaaccgcucacuccucaaacuaugggaagaccucaacccaaauaacccacuggaccgcugcugcccauucugcggccgacacaucggacaaauggcccucuucucaggagagacagaaauagaacacauaauaccauacucacgcucacucgaugauucagccgcuaacaaaguuaucgcacaucgcucuugcaacagagagaaaggaaaccgcaccccaugggaagccuggggccacacagaacgaugggccauaaucgcagaacaaguuucacgacuccauaaaagcaagcaauggagauucgccccagaugcaauagagagauuuaaccaagaaggcggguuuauagcaagacagcucuccgauacucaauaccuaagcaggauggcccgaaccuaccuaaguagccucuacccggacaccgccggcguauacgucauacccggccgcaugacagccaugcuacgcagacucuggggccucaacgaacuacuacccgaccacaacuacguagaaaauccacauucgggugcacccaagaaccgacucgaucacagacaccacgcgauagacgccgcaguaguaggaguaaccacgcgagggcuacucaacgagaucagucgagcagcagggcgagccgaaagacaggaccuggaccgccuguucauugaccucccaaagccgugggaaaccuucagagaggaccuacacgagagccucgccagagugguaggaagccacaaagcagaccacggcagaaaaggaguacccgcaaaaggaaaagacgcaacagccgcacgccuccacaaugagacagcauauggacuaacgggacucacaagugaaucaggguuaccaauaguaguccaccgcgucccucuccuaagccugaaaccggacgaccugagcaacccgauacgcaucccagacgcagcccuccaacgagcccugagagaagcgacugacggaaaaagcggaaaggacuuccaagaggcgcuagcccaauucucaaaaucagacccgguauucaaagggauccgucacguacgggugcgagaaacauuaaaggugauaccaauuagagacgcgagcggacacgcauucaaagccuacaaaggcgacgcaaacgccagauacgacguauggcgaaugccagacggcaaaugggucagcagcuggcgagacagagaugggaaagcccacagcggaauaaucacgauguucgcggcucaccaagccggacaacccgugcaacguccacacccagccgcaaaacgcguacucucgcucagacaaaacgaccuaguagcagucgaaccucaaggacagccgcgaaagauaaugcgagucguaaaguucagcuccggaggccaaauaaccuucgccgaacaucaggaagcaggcccccugaaagccagggacgcgacgucgcccgacauagacccuuucaaauauuuuuacagcuccgcaggaggccugcaaaaagcccgagcgagacagauccgaaucgaugagcucggccgcaucuucgauccuggaccaagauga

SEQ ID NO: 7315 - RNA, 3207 nt, Artificial Sequence
  Cas9 variant
augaaguacgugcugggccucgacaucgggaucgccagcugcggcugggccgucaucaaucaggagaagcaccgcaucgaggaccugggggugcggaucuucgauaaggcagagaacccgaaggacggcaagucccuggccaccccgcgccgggacgcccgcagcacccggcgcacgcuccggcgcaagaagcaccggaugcagcgcaucaaaauccugcuggugaagcacgggcuccuguccaagaccgagaucgaccaccuguacgagagcgccaccgagaucgacgucugguaccuccggcugaacgcccuggagcgccggcucaaccccaaagaguucgcgcgcgugcugauccaucuguccaagcggcgcggcuucaagagcaaccggaaggagaccacgcuauccgagaacggccagauccuggagaacaucagcgagaaccugcagaucauggagcagaagaacuaccgcaccgugggggagaugauccucaaggacaagcgguucgagaaccacaagcgcaacaaggacggcaccuacaucggaaccgucacgcggcaacagcugcaggaggagauccagaugaucuucaacgcccagagacuguacaagaacaaccacgccaccgagaaguucgaguccagcuaccucgagaucugggccucccagcggcccuacgcgagcaaggaccagaucgagaagaugaucggcuacugcacccuggagcccaaggagaagcgggugccgaaggccuccuggagcuuccaguacuucguggcccugcagaccaucaacaaccuccgccugaucuccaaggacagaaucgaggaguugagcuucgaggagaagaagcgaaucaugaaccucgcccuggagaaguccaucgucaaguacaucgauauccggaagcugcucucugugcccaaggaguuccaguucaacucccugagcuacagcgccgacaucguggacacgaccgucgagaacaagaagugcaucgaguuaaaggaguaccacuccaucaacaagguguacaagcagaucuacgggcagaacgcgcucaaccugcugcccaaggacuacgacaccaucgccuacggccucaccaucuucaaggacgacaaggacauccaggaauaccugcagaacaaguacgugaacgccaagggcaagcccaucagcaaccuggccaacaagacguacgacgacaccuucauccagguccuccugacccugaacuucuccaagaugggacaccucagcuucaaggcccugaagaacaucaucccguuccuggaggagggccucuccuacgacaaggcgugcgagaaggccggguacaacuucaagggcaccagcuacacgaagaagaccaaguaccugcccgugaucccccagaacaccaaccccgugguccaccgcgcacugucccagacccggaaggugauuaacgcuaucaucaaaaaguacggcaguccgaacgccauccacaucgagacagcgcgcgagcucuccaagaccuuccaggagcggaaggagauugacagcauguaccaggacaacuccaagaagaacgagcacgccaucugcaagcugaaggagcuggggaacaucaacccuagcggcaucaacaucgugaaguucaaguuauggaacgagcaggacgggcgcugcauguacaccggcaaguacaucgagccccaccgccucuucgaggagggguacaccgaggucgaccacauccugcccuacagccggagccuggaugacuccuacaacaacaaggugcucacgcugggcaccgaaaaccagcggaagggcaacaagaccccguacgaguacaugcgcaacaacagcaucugggacgaguucgagacccgggugcaguccaauaagaagaucaacaagaagaagcagcagaagcugcuccugcagaacuucagccacgcacgcgagcaggaguucaucgagcgaaaccugaacgacacgcgcuacgccaccaucuaccucuccagccugauccagcagcaucugaucuucagugaguccagccgggagaagaagguccacaccguguccgggaucaucaccagccaccuccgcuccagauggggcuucaacaaggaccggaaggaggggcacauccaccacgcccuggacgcgguuaucguggccgugacaagcgaccauaugauccagcgcgucaccaaauacuauaagcugaaggagcucaaccggaaccgccaggccaagcggaugcaguuccccgagccgugggagggcuuccgccuggaacuggaggcccggaucucccccaacacccagcaguaccucaaggggauccgcuucaagaacuacgcggacgugaaccugagcgagaucaagcccauuuucgugucccggaugcccaagcgcagcaucaccggcgagcuucaccaggagaccauccggaaguuccucggcuacaacgagaagggaaagguccugacggccaccaaaaccaaacuggaggacauccccuucgacgccaacggcgacuuucccauguucgggaaggagaccgaccucuacacguacaacgccaucaaggagcgcuaccugagucacaagaaggacaagagcaaguccuuccaggagccgcuguacaagcccaccaaaagcggcgggaucggcccccucauuaagagcauuaagaucauggacacccggaccaucgugaacccugugaaccagggcaagggggucguguacaacagcaagaucgcccgcacggacguguucaaaaagggcgagaaguacuaccugaucccgaucuacacaaucgaccugaugaagaacacccucccccagaaggcgaucaccgccgggaagggcuacgaggacuggacgaccaucgaccccuccuucaccuuccuguucagccuguuuccgaacgaccucauccagaucguccccagcaagaacaagaccaucaaggcccggacgaccguguccaaaaaggaggugcugcugcccagccucaccggcuacuucaaggggguccacuccggcaccgccgggaucacgguggagacccacgacggcagcaucaucgccaacgugggguccaagcagcugcuaaguuucgagaaguaccaggucgacgugcucggccacuacaccaagaucaagaaggagaaacgcaucggcauggcgaucuga

SEQ ID NO: 7316 - RNA, 3207 nt, Artificial Sequence
  Cas9 variant
augaacaaagcagucgccuacaggcuagcccuagaccucggaucaaccagccucggcugggcaaucuucagacucaaugaagcccgggaaccaacggcgauaauccgagcaggggugcgaaucuucucagacggcagaaacgccaacagcgagccacuagccguucaccgacgcguagcacgggcaaugaggagacgaagagaccgccuacuuaaaaggaagaaacgcaugcacgaccaacugguccaacacggauucuucccagcagaaguagcagaacgcaaagaacuagagcgucugaacccauaccaauugcgcgcaaaaggacuacacgaagcgcugacgccaggggaguucgcaagagcccuauuccacauaaaucaaaggcgcggcuucaaaagcaaucguaagacagaccgaaaagacaaugacagcggggcacucaaacaagcgauaagugaacucagaaaaagaauacaagauuccgacugcgcaacagcaggcgaaugguucuggaaggaaagaaugcagcaaaaacccgaaggagugcgcggacaauggguacgagcgcgguacagaaaaacgcccagcaccacagacgaagggaagaaaaggaucggguacgacuuauacguagaucgugccaugguagaacaagaguucgacgcccucugggcggcgcaagcagcguuacaacccggucuauucaccgaagcggcaagagccgaacuaaaagacacacuccucuaccaacgagaccucaggccaguaaaacccgggaggugcacgcucuuaccagcggaagaaagagcuccccuagcauuacccuccacgcaacgcuucagaauccuacaagaggugaacaaccuccgacugcuagacgaagcccuacgcgaaguaccacuaaaucucgcgcaaagagacgccgucgugagcgcacucgaaggaaagaaagaacucagcuucgcggccauacguaaacuauugacccuuucaggcaaauucaaccuagaagaugaaaaacgcgcugaacuaaaaggaaacgcaacaagugucauccucgcacggaaagaccuauucggagacgcgugggcaggauucgaugcagccguacaagacgaaauagucuggcgucuagucagccaagagucagagggcgcgcucauagccuggcuacaacagcacacaggcgucgacggcgugugcgccgaagcaauaguaaacacccgccugcccgauggcuacggaagacuaagccgcaaagcacuggaaagaaucgucccggcacuacagagagaaguaugcacauacgacaaggcagugcaggcggcaggcuucgcccaccauucggaccuaggguucgacuucgacuacgcagaagacgagguacaacaaguaggggaacauacaauagccuccaccggggaggugcaggcgcaauacgcuuucaagcaacucccauacuacggaaaagcacuacaacgucacguagcauucggcagcggcgacgccaaagaucacgaagaaaaauguuauggcaaaaucgcaaacccaacaguccacauaggccuaaaccaaguaagaacggugguaaacgcucuaauccgccgcuacggacacccgaccgaaguaguaguagaacucgcccgagaccucaagcaaucacgcgagcaaaaacagcagacccaaagggagcaagcggacaaccagaagcgcaaugaagacauacggaaacggauagcaccaauccucgagaccagcccugaacgagucagagaccgagauaucaaaaaguggauccucugggaggagcuaaacaagaaggacauagcggaccgacacugccccuauaguggcgaacggaucucagcaacaauguuacucagugaagcaguggaaauagaacacauccucccguucagcagaacauuagacgacucacucaacaaccggacagucgcaaugagacgagcaaaccgaaucaaaggagaccgaacaccaugggaggccagggccgacuucgaagcacagggauggagguacgaagcaauccuacaaagggcagagggcaugccgcccaggaaacgauacagauucgccgaagauggguaucaacgcuggcucggaaaagaccggaacuuucuagcgcgagcgcuaaacgauacgucuuaccuaucccgacuagcagcuaauuaccuccgauuagugugcccccagggaguacgagugauacccggacagaugacagauaaacuaaggggcaaauucggacucaacucaguacucggcuuagacggcaagaaaaaccgaaacgaccaccggcaccacgcagucgacgcuuguguaauaggcgugacagaucaaggccucaugcaacgguucgccaacgcgagcaaacaagcccgagaaaacggacuaaccagacugguacaagauaugcugcugcccugguggccguccuacuacgaccacguagaacgcgcaguccgccacauccgaguaucgcacagacccgaccacggcuucgagggagccaugaugaagggaacggcgcacggcauaagagaagacggaauccgcgaggacggacgcauaaaacaacgcccgaaagccaagggcuccgcggaccacaaaaccauaacacucauaccaauagaugaaccccgccaacucgcacgccacgggguagacgccgagggaaaaccccucccauacaagggauacgcauccggaagcaacuacugcauagagauuaccaaaaacggaaagggaaaaugggaaggacaaguaauaagcacauucgacgccuacagaauaaaagcggcagcagacgcagccgcacgagcaggccaggugauuagcacaguagaagccgacagcauaguucgaaagucagggugggaaagacuccggggcgcacaaagccaaaacggccagccccugguaaugcgacucguuauaggcgauucaguccggauggaaguggacgggagagacgagguuaugagaguaguaaaaauguccggcaaggagaugguauucgcccccguaagagaagccaauguagacaaacgaaauaauaugccggacgaacaggacccauucaccuauacuuacaaacgggcagaccagcucaggaaagcaaaagcaagacaaguaaccaucagcccaauuggagaacuaagggaccccggguucaaaggguga

SEQ ID NO: 7317 - RNA, 3207 nt, Artificial Sequence
  Cas9 variant
augcaguacgugcugggccucgacauugggaucgccagcugcggcugggccgucauaaaccaggagaaggagcguaucgaagaucugggggugcggaucuucgacaaggcggagaaccccaaggacggcaagucccuggccgccccgcgccgggacgcccgcagcacccggcgcacccuccggcgcaagaagcaccggaugcugcgcaucaagauccugcucgugaaacaggggcugcuguccaagaacgagcucaaccaccuguacgagagcacgacugaggucgacguguggaaccugcggcucgacgcccuggagcgcaagcugaaccccaaggaguucacccgggugcucauccaccuggcgaagcgccggggcuucaaguccaaccgcaaggagaccacgcugagcgagaacggucagauccucgaguccaucagcgagaaccagcagaucauggagcagcagaauuaccggaccgucggggagaugauccugaaggacaagaaguucgagaaccacaagcgcaacaaggacggcaccuacaucgggaccgugacgcgacagcagcuacaggaggagauccagaugaucuucaccgcccagcgccucuacaagaacgacuacgccaccgaggaguucgaaaucuccuaccuggagaucugggccagccagcggcccuacgcguccaaggaccagaucgagaagaugaucggcuacugcacccuggagcccaaggagaagcgcgugccgaaggccagcuggucauuccaguacuucgucgcccuccagacaaucaacaaccugcgacugaucagcaaggaccggaucgaggagcucuccuucaaggagaagaagcagaucaugaaccuggccuuagagaaguccaucgugaaguacaucgacauccgcaagcuccugagcauccccaacgaguuccaguucaacagccuguccuacagcgccgacacaguggacaccacccucgaaaacaagcggugcauugagcugaaggaguacuacagcaucaacaaggucuacaagcagaucuacgagaagaacgcgcugaaucuccugcccaucgacuacgacacaaucgccuacgggcugaccaucuucaaggacgacaaggacauccucgaguaccugcagaacaaguacgugaacgccaagggcaagcccauaaacaaccuggccaagaagaccuacgacuacacguucauccaggcccuccugacgcugaacuucaccaagaugggccaccucuccuucaaggcgcuuaagaacaucaucccguuccuggaggaaggccucagcuacgacaaggccugcgagaaggccgguuacaacuucaaggggaccuccuacaccgagaagacgaaguaccugcccgugaucccccagaacaccaaccccgucgugcaccgcgcccugagccaaacccggaaggugaucaacgccaucaucaagaaguacggcuccccgaacgcgauccacaucgagacugcccgcgagcugagcaagacguuccaggagcggaaggagaucgacuccauguaccaggacaacagcaagaagaacgaacacgccauccacaagcucaaggagcugggcaacaucaaccccuccgggaucaacaucgucaaguucaagcuguggaacgaacaggacggccgcugcauguacagcgggaaguauaucgagccccaccgccucuucgaggagggcuacaccgagguggaccacauccugcccuacucccggagccuggacgacuccuacaacaacaagacccucacccuggggacggagaaccagcggaagggcaacaagaccccguacgaguacaugggcaacaccagcaucuggaacgacuucgagacccgcgugcacuccaacaagaagaucaacaagaagaagcagcagaagcugcuccugcagcacuucagcuaugcccgggagcaagaguucaucgaacgcaaccugaacgacacgcgguacgccaccaucuaccucuccagccugauccagcagcaccugaucuucuccgagagcagccgcaagaagaagguccacaccguauccgggaucaucaccagccaccuacggucccgcuggggcuucaacaaggaccggaaggaggggcacauccaccacgcgcuggacgccgugaucguggccgugaccagcgaucacaugauacagcgcguaacgaaguacuacaaacugaaggagcucaaccgcaaccugcaagccaagcggaugcccuuccccgagcccugggagggcuuccgccuggagcucgaggcgcggaucuccccgaacacccagcaguaccugaagggguuccgcuucaaaaacuacgccgacgugaaccugagcgagaucaagccgaucuucgugucccggaugcccaagcgcagcaucaccggcgagcuccaccaggagaccauccggaaguucaucggcuacaacgagaaggggaagguccugacggccaucaagaccaagcuggaagacauccccuucgacgccaacggcgacuucccgauguacgggaaggagaccgaccucuacaccuacaacgccaucaaggagcgcuuccugucccacaagaaggacaagcgcaagagcuuccaggagccccuguacaagcccacgaaguccggcgggaucggccccuuaaucaagagcaucaagaucaucgacacccggaccauagugaacccggugaaccagggcaagggggugguguacaacucgaagaucgcgcggaccgacguguucaagaaggacgagaaguacuaccuaauccccaucuacacgaucgaccugaugaagaacauccucccccagaaggccaucaccgccggcaagggguacgaggacuggaccacaaucgacccgagcuucacguuccuguucucccuguuccccaacgaccucauccagauaguacccagcaagaacaagaccaucaaagcccgcaccaccguguccaagaaggaggugcugcugccuagccucacgggcuacuucaagggcguccacagcgggaccgccggcaucaccguggagacccacgacgggucugugaucgcgaacgucggcagcaaacagcugcugcucaucgaaaaguaccagguggacauccuggggcacuacacgaagaucaaggaggagaagcggaucggcauggccaucuga

SEQ ID NO: 7318 - RNA, 3207 nt, Artificial Sequence
  Cas9 variant
augccaaaguccgccaaaccccaacaagcauacacccuaggccucgacaucggaauagccagcguaggcgcagcccuacucggacaacaacacaucauuggccuccacguccgaaccuucgaccgcgcagaaacagccaaggaaggcgaaccgcuaaauaaaauaaggcgugacgcacgccucacaagaagacgacuacaacgaagggcacaucgacucuuaagacuaagaagauuauucaaacgccacaaccucauacccgacacggacaccucuacauucauaucaggccagucgcccugggaacuucgcgcacaaggacucgaccgccaacucacaagcgcagaguggaccacuguacuauaucacauugucaaacacagaggguuccacagcaaccgcaaaagcgaagucaaaaccgacgaaaaagccggacagaugcucagcgguguaaaccaaaaccaagcccugcucaaacaauccggacuccgcacaaugggcgaauuagccgcccgacaugaggcauuccgcgaagcuaagcgaaauaagaagggcgcuuacaaucacacauucagccgccacgaucuagaggacgagcuacaccuccucuucucccgccaacgcgaacucggcaacccuuaugcaaccccagaacuagaagaugcaguacacacacuguuaaugcagcgccgcccugcacucucagggacaaaccuccugaaaauggucggacacugcacauuggaacccgacgaguuccgagcaccaaaggcguccuacacugcugaacgauuuauauggcuuacuaagcuaaacaaccuacgcgucucgggcucuggcgaaacuaggccccuaaacgaaagcgaacggcaagcccuacucagcaagccguucucucaauccaaacugaccuacaaacaggugcgaaagauccuagagcuacccgacaacauccgauucguagggcuccauuaccacccagcccaagacaacggaaaauccccagaaaacagaguauuuuucgaagcuaaagcauuucacgcccugcgcaacgucuacaagaaagccggucugaaccucgaguggcaacgagacagccaaaaccccgaaaaacucgacaacaucacauacgcacuaacgguauucaaagaagacaaagaagcgaagcaguggcuuauagaaaagggaguagaagcaagcguaauagaagccguccucaacgaaucauucagugaguucguccgccucucgauuaaagcacuccgcaaaauuaucccacacauggaaauaggccacagauacgacgaagcagugaaacucgccggauacagccaucauucacaccucccacaacccuccaaaacacccuacauaccccguuuuuccaaacaauccauagccaauccggucgucagucgcgcacuaaaccaagcccguaagcucgugaacgcaauaguuagggaguauggacccccggacgccguacacauugagcucgcacgugaccuaaacaaacccuucgacgaacgacggaagauagaaaaagaccaagaaaaguaccaaaaagacaaagcccgagacauagaaacauuucaagaaaacuucggcuucaccccgaaggggcuacaacuuacaaaauggagacuauaccgagaacagucagggaaaugugccuacagccuuaaaccccucgacaucaaucgacuauucgaagacggcuacguggaaaucgaccacgcccuuccguacagccgcuccuuuaaugacggcaugaacaacaaaguauuaacacuaacaacggaaaaccgcaacaaaggcaaucaaacaccguacgaauaccucgacggcgccagcaacucagcacaguggcgcaacuucguagcaugggucaacagcaacaaaucuuaccgcgccucaaaacagagaaaccuacuccgaaaagacuuugccgcccaagcagcaacugaguucagagaacgccaccucaccgacaccagauacaucgcgagagaguucaaacgcaugguagaaacacaccucaaacucaacaaaccaaaccaaaggugcguaguagugagcggccaacuaacagcuuaccuacgagcccgauggggacuaaucaaaguccgagaaaacggggaccugcaccacgcccuagacgcggccgucguagccgcaugcucccacgccauggucaaacguuuagccgacuacagccgccgcggagaacuacaauacgcacgaggacaccacuucgaccccgaaaccggcgaaauaaucgacaucaacgcccugcgcaaacuagacgaccacuucccacaaccauggacggacuuccgucgagaacuacucgcuugguugagcccagaccccgcacaacaauugaaaaaccuagcauacuacaccgacgaacggcuuaaacaaguaaaaccuauccgcgucagcagagcccccacccgacgugggcugggcgcagcacaccaggaaacuauaagaucagccaaguaccucggcgaaaaccgauccaccguaaagacgccccucgaaaaacucaaacuaaaggacauacccaacauagucggcuacgaagacccacggaaucaccaacuaauccaagcgauaucccaaagacucaccgaacacggugacgacggcaaaaaggcauucaaagaaccccuauacaagccgggaaauaacaaaagcaccgcacccgucguacgcucagugaaacuauucacaguccaaaagagcggaaucccagugcgaggaggaaucgccaacaacggaaauaugguaagagucgacauuuucaccaagaaagaacgauacuucgccguccccguauacgucucggaugccgcccgaaacgaacuaccaaacaaagccguagccagaggaaaagacggguggauagacaucgacgacuccuucuccuuucuauucagccucuaccccaacgauugggucagcguaguggugaaaccccacgaagccccaugcgaaggauacuacgcgggucucgacauuucgaccggagcaauccacaucugggcgcaugauagaaacagauccgucggcaagaacgggcucaugcgcuccaucgggauaaaaacugcccacucggucgagaaauaucacguagaucugcuagggaaccucuacagagucguucaugagaccagaaaaccucugcgggcaggcaaauga

SEQ ID NO: 7319 - RNA, 3207 nt, Artificial Sequence
  Cas9 variant
augcaguaugugcugggccucgacaucgggaucgccagcugcggcugggccgucauaaaccaggagaaggagcgcaucgaggaccugggggugcggaucuucgacaaggcggagaaccccaaagacggcaaguccauggccaccccgcgccgggacgcccgcagcacccggcgcacgcugcggcgcaagaagcaccggaugcagcgcaucaagaucauccucgugaaacaggggcuccuguccaagacagagcucgaccaccuguacgaaagcgccaccgaggucgacguguggaaccugaggcucgacgcccuggagcgcaaguugaaccccaaggaguucacccgggugcucauccaccuggcgaagcgccggggcuucaaguccaaccgcaaggagacgacgcugagcgagaacggccagauccucgaguccaucagcgagaaccagcagaucauggggcagaagaacuaccggaccgucggcgagaugauccugcaggacaagaaguucgagucccacaagcgcaacaaggacgggaccuacaucggcacggugacccggcagcagcugcaggacgagauccagaugaucuucaacgcccagcgccucuacaagaacaacuacgccaccgccgaguucgagaacagcuaccuggagaucugggcgucccagcggcccuacgcaagcaaggaccagaucgaaaagaugaucggguacugcacccuggagcagaaggagaagcgcgcccccaaggccuccuggagcuuccaguacuucguggcccuccagacgaucaacaaccugcgccugaucuccaaggacaggaucgaggagcucagcuucgaggaaaagaagcagaucaugaaccuggcgcuggagaaguccaucgucaaguacaucgacauccgcaagcuccugagcgugccgaacgaguuccaguucaacucucugagcuacagcgccgacaccguugacaucaccgucgagucccguaagugcaucgagcuuaaggaguaccacagcaucaacaagguguacaagcagaucuacgaaaagaacgccuugaaccugcuccccaaggacuacgacaccaucgccuacggccugacgaucuucaaggacgacaaggacauccuggaguaccuccagaacaaguaugugaaugccaagggcaagcccaucucuaacuucgcgaacaagaccuacgacgacaccuuuauccaggcccugcugaaccucaacuucaccaagauggggcaccugagcuucaaggcccugaagaacauaauccccuucuuagaggagggccuguccuacgacaaggccugcgagaaggccggguacaacuucaagggcacgagcuacaccgagaagaccaaguaccugccggucaucccccaaaacaccaaccccguggugcaccgcgcgcucagccagacgcggaaggucaucaacgccaucaucaagaaguacggcagccccaacgccauccacaucgagaccgcccgggagcuguccaagacauuccaggagcggaaggagaucgacagcauguaccaggacaacuccaaaaagaacgagcacgccaucugcaagcugaaggagcucgggaacaucaacccgagcggcaucaacaucgugaaguucaagcuguggaacgagcaggacgggcgcugcauguacuccggcaaguacaucgagccccaccgucuguucgaggagggguacaccgagguggaccacauccugcccuacagccgcucccucgacgacagcuacaacaacaagacgcucacccugggcaccgagaaccagcggaaagggaacaagacccccuaugaguacauggggaacacguccaucuggaacgacuucgaaacccgcguccagagcaacaagaagaucaccaagaagaagcagcagaagcuccugcugcagcacuucuccuacgcgcgggagcaggaguucaucgagcgcaaccucaacgacacccgguacgccaccaucuaccugagcagccugauccagcagcaccucaucuucuccgagagcucccgcaagaagaaggugcacaccgugucgggcaucaucaccagucaccuccggagccgguggggauucaacaaggaccggaaggagggccacauccaccacgcccuggacgcggucaucguggcggucaccuccgaccacaugauucagcgcgugaccaaguacuacaagcuaaaggagcugaaccgcaaccugcaggccaagcggaugccguuccccgagcccugggagggguuccgccucgagcuggaggcccggaucagccccaacacgcagcaguaucugaaaggcuuccgcuucaagaacuacgccgacgugaaccucuccgagaucaagccgaucuucgucagccggaugcccaagcgcuccaucaccggcgagcugcaccaggagaccauccggaaguucaucggguacaacgagaagggcaaggugcugaccgccaucaagaccaagcucgaagacauccccuucgacgcgaacggggauuuccccauguacggcaaggagaccgaccuguacaccuacaacgccaucaaggagcgcuuccugagccacaagaaggacaagcggaaguccuuccaggagccgcucuacaagcccaccaagagcgggggcaucggcccccugaucaaguccaucaagaucaucgacacgcgcaccaucgugaaccccgucaaccaggggaagggcgugguguacaacagcaagaucgcccggaccgacgucuucaagaaggacgagaaguacuaccucaucccgaucuacaccaucgaccucaugaagaacaucuuaccccagaaggccaucacggccgggaagggcuacgaggacuggaccaccaucgaccccagcuucaccuuccuauucagccucuucccgaacgaccugauccagauugugcccagcaagaacaagacgaucaaggcgcgcaccaccgucagcaagaaggaggugcugcuccccagccugaccggcuacuucaagggggugcacuccggcacggccgggaucaccguggagacccacgacggcagcgucaucgccaacgucggguccaagcagcugcuccuguucgagaaguaccagguggacgucuugggccacuacaccaagaucaaggaggagaaacgaauaggcauggccaucuga

SEQ ID NO: 7320 - RNA, 3210 nt, Artificial Sequence
  Cas9 variant
augaagaaacagccacagagauacaucuugggccuagaccuuggcauagcauccgucggcugggcccuaauacucgucgacggggccgaaaaccccgucggccuauuagauugcggcguaagaaccuucgaaagggcagaaguccccaaaacgggcgacagccucgcacucgcacggcgccaagccagaucuguacgccgccucauccgacgacgagcgcacagacuccuccgucuacgccgccuccucaaacgggaaggaauauuauccgcagcagacuucaacucagacggacugcccaaccuacccaucgacgccuggcaacugcgcguagccggucuagaacgaaaacuaacgaaccaagaaugggccgcagugcuccuccaccuugucaaacaucggggauaccucucgcaaagaaaaagcgaaacucaaacggagaacaaagaguuggggcgccuccuagccggugucgcagaaaauuccaaacuacucagcgaaagcagcgaacaguacagaaccccggcagaacuagcaguuaaacuauucgccgagcaauccggacgccucagaaauaaaggcggcgacuacacgcacacguuuaaccgacucgaccuccaaaaagagcuacaccuacuguucgaacgucaaugcgcacuaggaaaccccuucgccucggcagagcuccaaucaaaaguagacgaacuucuaaugacacagcgcagugcccuacagggcgaagccguccuaaaaaugcuaggcaaauguaccuucgagccgucagaauacaaagcagccaaaaauaccuacucggccgagcgauucauauggcuuacaaaacucaacaaccuaaggauccuauacaacggcgaggaccgagcacuggacgagggagagcgaaaacagcuccucgacgaaccauacaagaaagcaaaacucacauacaaacaaguccgcagcauccugaaccuaccagaaucagcgguauucaaaggucuccgauacggaaaagacagcgacggccuaaaagcggagaacggagcccugauggaaaugaaggcauaccacaaaauccgaaccguacuggagaaggccggacucaaaggcgaaugggaaaaccgcauucgaaacccggagauucucgaccaaaucggcaccgcauucuccguauauaaaaccgacgaagacaucaaagccgaauuagccgcucuccggcugccugaaaacguccuggacgcccugcuagccgggcuaaacuucgacaaauucauacaacucucacuaaaggcccuauccaacauacucccccucauggagcgcggaauccgcuacgacgaagccugcaaagagguguacggcgaccaccgagcacuagcggaaagcaaaaaccagaugcugcuaccccagauaccagcaaacgagauuagaaacccggucguccuccgaacacuaacacaagcucgaaaaguaaucaacgcaaucauacgcagauacggcuccccacaaaggguccacaucgaaaccgcgcgcgaacucgguaagagcuucaaagaucgcaaagaaauagaaaaacgacaagaggaaaaccgcaaagaaagagagcgagccgcagaacauuucaaagaacuauucccgcgcuuuacgggagaaccaaagagcggagacauccugaaauuacgccucuaucaacaacaacaaggaaaaugccuguacagcgggauacccauagaccucggccgccugaacgaaaaaggauacguagaaauagaccacgcccuaccauucucacgaacaugggacgacuccuucaacaacaaaguccucguccucggaucagaaaaucaaaagaaaagaaaccaaacgccguacgaauaccuugacggagcacgggacagccaacgcuggcgugaguuccaagcccgcguacaaggcugcagguuccccuacgcgaagaaacaaagaauccagacagccaaauuagacucaaaaacugaacaaggauuccuagaacgaaacuuaaacgacacacgauacauagcacgauuucucugcggguuuauagagaaaucccuacaucuccaaggcgccggcaaaagacgaguauucgcaucaaauggucaaauaacggcguuacuacggggacuauggggacugaagaaaguacgcgaagacaacgaccggcaccacgcgcucgacgcuaucguggucgccugcucaacaguuagcaugcaacagaaaaucaccaaagcaaugcaacgcagagaaacccuagaaacgauaaacacggagacaggggaagucaaaacacgcaucccccaacccugggacuucuuccgccaagaagucaugauacgcgucuucagcgacgcaccccgcgaagaacuagccgaaaaacucaacucacgccccgaagcacuacacgacuucguaagcccacuauucguaucucgggcgccaaaccgaaaaaugacagggcaaggacaccucgaaacagugaaaucagcaaaacgccucagcgaaaacaucagcgucgugaagaaaccacuaacagcacugaaacucaaagacaucgaaaacauaguaggauauccagaccgcgagccagcccuguaccgcgcccuccaggaacgccuccaagcauacaaagaugaccccgccaaagcauucgccgaacccuuuuauaaaccagccaaagacggcggccaaggcucauuagucaaagcgguacgaauaaucgaaaacaccaaacacggacuaaaagugcggaacgggaucacagacacgaauggcgacaugguccgagcagacguauaccagaaggccgauaagaaagguaaacgacaauacuucauaguccccguauacgcauggcagguagagaaaaacgaacucccgacaguugacugcaagggauacgaaauagacgacaccuacgaguucugcuucaguuuauacaaauacgacaucauagaaauacaaaaccccgacaauaugagcaaagaacuccgcgucuacuacauaaacugcgacucauccgacgggcgauucuggcuggcacaccacgacaaaucggcaaaagaacaacaauucaggauaucaacacagaaccagcccauaauaaagaaguaccaagucgacccgcucggaaaagaaauccgacuaugcaaagcggagaaaagaaccgaacuaaauggaaagaagaagaaauga

SEQ ID NO: 7321 - RNA, 3210 nt, Artificial Sequence
  Cas9 variant
augaacuacgacaucggacugcgcaucgggaucaccagcugcggcugguccaucaucaacaaggaccucgagcggaucgaggaccugggggugcgcgucuucgagaaggcagagaacccugauggaaccgccagcgccgccccgcgucgcgaggcccguaagucgcgccggaagcaccgccggaagaagcaccgcaucgagcgaaucaagcgucugauugugcagcacgaucuccugagcaagaaggagcuggacucccucuaccucagcccauucaacaucgacguguggaaccugcgggucgaggcccucgagcgcaagcucgacaaccgggaguucgccagagugcugauccaccucgugcagcgacguggcuuccagaccauccggaaauccgucgagauccaggaggaggguaagcugcuggagaaugugagcgagaacgagcgcaucaugaaggugaacggguacaagaccguaggggagauguuuagcaagcacgagaaguucacccaccacaaacggaauaaagacggcagcuacaccucggugguaacgcgcagccuccugcucaaggaaauuaagaccaucuucaacucccaacgcauccucgggaacgucuucucaacccaaaaacuggaguccgacuaccuguacaucuggggaagccagcggccgacacuaacuuacgagcagcugaugucaaugguggggaacugcaucuacgagaagaaggagaaacgcgcgccgaagacguccugggccuuccaguacuucucccugcuccaaaagaucaacaagcucaaggugagcgacgacaauacccugcggaagcucagcaaggaggagcgcgacaucgucaucgaguuggcuuuuaaaaagaaaaacguguccuucguggacauccggaaggcccugaagcuaaacgauaacaccaaguucaaccaccugacguacagccacgucguggagaccaagaagguggagaaggcgaccuucaucgaguuaaagggcuaccaccucauuaagaagcagcugaaggaccgcaacguugagcuaacucaagaacuccagccgaaggacuacgaugccaucgccgccgccucuacguucuucaaaaacgacauagaguuucgggacuaccugcgcaaccaguaccuggacagcaacggaaagcggaaguccaacauagcgaacaagguguucgaagacaaggugauagccgccgucuucgagcucaacuucagcaaggugugccaccugagcuucaaaagccuguacaagcucaucccgcaccuggagaaagggcuggacuacaaggaggccauccucugcgccggcuacaacuuccgggacgagaacaagcgugacaagaaacuuuuccuucccgucauucagcaagagaccaaccccgugguccaccgcgcacucacacaggcccggaaggugaucaacgccaucauccgcgaguacgggaguccgaacaccaucagguucguaguggccaaugaccuggccaagacguacaagcagcgcaaggagcuggagucgacuuuaaagaagaaucgggcggagaacgagaagaucaagaccaagcuccucuccaugggcaucaucaaccccaccgggauggacauagucaaguacaagcugugguacgagcagagcgggaucugccucuacacgggccgccagauggagcuguccagccuguucaagccuggguacuccaucguuaaccauaucauccccuacaaccggagcuucgacgacaccuaccacaaccgcgugcucacccugaccgagacgaaguacgagaagggcaacaagaucccguucgaguacuucggggccgaggagaccugcuggaacgaguacgagaagcgcguuuccaccagcaagaagauccacgacaagaagcgggaaaagcugcucauccgcaauuucgauaucgaguacgagaacgagaugauuuccaacaacguguucgacacccacuauaucggcaguuacuuugagaaauacaucgaugagcaccuccaguucaaaaaguccacgaagaagcagaaggucuuuuccauccacggaaacauggucgcccaccuacacagccgauggggguucaacaagaacucccgcgagauauaccugaaccacgcuguggacgccgcgaucguugccguccugaccgaccagcugauccggaacaucgccgauuacuaucgccgggacaacauccuggagcagaaggguagccugaaguucccagagcccuggaaguccuucucuaucgagcuggaggccaggaucagcccccagguccgggaccucauuaagaagcugaaccuggacagcuaccucgacguggacauccugcauaucaagccggucuucaucagcaagaagcccagacggaaggugaacggggaggcgcacaagagcaccaucagaucccugaucggcaucaacgagaucggcaagaccgugacgugcaucaagacccggcucgaggacauccccuucgacgagaacggggacuuucccauguacggcaaggacaccgacaaguacaccuacaccgccaucaaagaacgauaccuggaguucaacaaggauaaagagaaggccuucucgacgccccuguacaagcucaagcggaacggggagcccggcaaccagaucaaguccgucaagauaaucgacaccaggaacaucguuaacaaagugaaccaggguaagggcaucgccuacaacagcaacaucaucagagucgacguguuuuccagggaccagaaguacuacgucguccccaucuaccugagagacuucauuaaggggagccugcccaacaagauaaucaccgccgcgaagggcuucaugcaguggccggagaccgacaacuccuacacuuuccucuucagcaucuuccccaacgaccugaucaagguugugcccaaggagggcaaguuuaucaaggcuaagaacgagaacaaggagaacaucaaccucaccgagauccuuggguacuucaagggccuggacagcagcacgggggccuucacccuggaaagccacgacggcucccuucuggcccgcggcaucgggacgaagaaucugcuccugaucgagaaguaccaggucgacgugcugggccgguacaacaagguggggaacgaggagcgccaagacaucaagauccagcaaaacuga

SEQ ID NO: 7322 - RNA, 3210 nt, Artificial Sequence
  Cas9 variant
augaacuacgacaucggccugcgcaucgggaucaccagcugcggcugguccaucaucaacaaggaccucgagcggaucgaggaccuggggguacgcgucuucgagaaggccgagaaccccgacgguaccgccagcgcggccccgcggcgcgaggccagaaagucccgcagaaagcaccgccguaagaagcaccgcaucgagcggaucaagcgccugaucgugcagcacgaccuccugagcaagaaggagcuggacucccucuaccugucacccuucaacauugacguguggaaccuacaggucgaggcccucgagcggaagcucgacaaccgcgaguucgcacgggugcugauccaccucgugcagcgacggggguuccagacgauccgcaaguccgucgagauccaggaggagggcaagcugcuggagaacgugagcgagaacgagcggaucaugaaggugaacggcuacaaaaccgucggggagauguucuccaagcaugagaaguucacccaccacaagcgcaacaaggacggcagcuacaccuccguggugacgcggagccuccugcugaaggagaucaagaccaucuucaacucccagcgcauccucgggaacgucuucagcacccagaagcuggaguccgacuaccuguacaucuggggcagccagcgccccacccucacguacgagcagcugauguccaugguggggaauugcaucuacgagaagaaggagaagcgggcgcccaagaccagcugggccuuccaguacuucucccugcuccagaagaucaacaagcuaaaggugagcgacgacaacacccugcgcaagcucagcaaggaggagcgggacaucgugaucgagcuggccuucaagaagaagaacguguccuucguggacauccgcaaggcccuaaagcucaacgacaacaccaaguucaaccaccugacguacagccacgucguugagaccaagaagguggagaaggcgaccuucaucgagcugaaaggcuaccaucucaucaagaagcagcugaaggaccggaacgucgagcugacccaggagcuccagccgaaggacuacgacgcaaucgccgccgccuccacguucuucaagaacgacaucgaguuccgcgacuaucugcggaaccaguaccuggauagcaacggcaagcgcaaguccaacaucgcgaacaagguauucgaggacaaggugaucgccgccgucuucgagcucaacuucagcaaggugugccaccuguccuuuaagagccuguacaagcucaucccccaccuggagaaggggcuggacuacaaggaggccauccucugcgccggcuacaacuuccgggacgagaauaagcgcgacaagaagcuguuccugcccgucauccagcaggagaccaaccccguggugcaccgggcgcucacccaggcucgcaaggucaucaacgccauaauccgggaguacggguccccgaacaccauccgcuucgugguggccaacgaccuggccaagacguacaagcagcggaaggagcuggagucaacccugaagaagaaccgcgcggagaacgagaagaucaagaccaagcuccuguccaugggcaucaucaaccccaccggcauggacaucgucaaguacaagcugugguacgagcagagcgggaucugccucuacacgggccggcagauggagcuguccagccuguucaagccaggguacuccaucgugaaccacaucauccccuacaaccgcagcuucgaugacacuuaccacaaccgggugcucacucugacugagacgaaguacgagaagggcaacaagaucccguucgaguacuucggggccgaggagaccugcuggaacgaguacgaaaaacgcgucuccaccagcaagaagauccacgacaagaagcgcgagaaguuacucauccggaacuucgacaucgaguacgagaacgagaugaucuccaacaacguguucgacacccacuacaucggcagcuacuucgagaaguacaucgacgagcaccuccaguucaagaaguccacuaagaagcagaagguguucuccauccacggcaacauggucgcccaccuccacucgcggugggguuucaacaagaacucccgggagaucuaccugaaccacgccguggaugccgcgaucguggccguccugaccgaccagcugauccgcaauaucgccgacuacuaccggcgcgacaacauccuggagcagaagggcagccugaaguuccccgagcccuggaaguccuucagcaucgagcuggaggcccggaucagcccccagguuagagaccucaucaagaagcuaaaccuggacagcuacuuagacguggacauccugcacaucaagccggucuucaucagcaagaagccccggcgcaaggugaacggggaagcgcacaagagcaccauccguucccugaucggcaucaacgagaucgggaagaccgugacgugcaucaagacccgccucgaggacauccccuuugacgagaacggcgacuuccccauguacggcaaggacaccgacaaguacaccuacaccgccaucaaggagcgguaccuggaguucaacaaggacaaggaaaaggccuucagcacgccgcuguacaagcucaaacgcaacggggagcccggcaaccagaucaaguccgucaagaucaucgacacccggaacaucgugaacaagguaaaccaggggaagggcaucgccuacaacagcaacaucauccgcgucgacguguucuccagggaccaaaaguauuacgugguccccaucuaccugcgcgacuucaucaaggggagccugcccaacaagaucaucaccgccgcgaagggcuucaugcaguggccggagacggacaacuccuacacguuccucuucagcauauuucccaacgaccugaucaagguggugcccaaggaaggcaaguucaucaaggccaagaacgagaacaaggagaauaucaaccugaccgagauccucggguacuucaagggucuggacagcuccaccggggccuuuacccuggagagucacgacggcucccuccuggcccggggcaucgggacgaagaaccugcuccuaaucgagaaguaccaggucgacgugcugggccgcuacaacaagguggggaacgaggagcggcaggauaucaagauacagcagaacuga

SEQ ID NO: 7323 - RNA, 3213 nt, Artificial Sequence
  Cas9 variant
auggcuacacgcuugggacucgacauaggaaccaacucaauaggauggugccuguaugacggcgacucaaucagagacaucggaguacgcaucuucuuagacggcagagaaccaagcaaacuaaccguaaguggcagcggcacaccccuagccguaaaaagaagggacgcacgcggagcacgacggagacgcgaccgcuacaucggccgacgaagcgcaaugcuacgagaauuaagaaaacacggacuacuaccggccgacccaaaacaagcgaagguacucgaaacacaagacccauacgcccuacgcgucagggcccuagaugaaaaacuagagccccaccaaauaggacgagcacucuuccaucuaaaccaacgacggggauucaaaagcaaccgaaaggccgagagggccucaaaagccggggaagacggaaaaauagccacggcaacgaaacuacucgacgaagagaugcagcgccuuggagcacgaacccucggagaguuccucgugaaaagagacuccgaguucgacggagaagcgggaaagcguguacgaaugcgagcggacaguaaagcauacgacuuuuaccccgaccgccgacacgugcuggacgaguuccgagcaauauggaacgcccagaagguauggcacccggaacuauuaacagaacaagcauggaacgacaucuuccgagucaucgaauaccaacgcgaacuaaaaccacaggucguuggccacugcacauuugcggggauaaacggcgucccagcagacgagaaaaggcucccaaaagcccauccccuauuccaacaacgacgccuuuacgaagaaguaaaccagcucaagguggucgcgccgggagaagcaggccggccacuaacacgggaugaacgagacgcacucauacuaaagcuacaagacaagaaaagcgucagcuucgagacacuggggaaaacacuaaaacuaaaagauggagaacgauucaacaaagaaagcgaaaaccgcaaagccuuagacggcgacgagguaagggccgcacucuccgggaagaaacuguucgggacccgaugguuccacuucagcgcagaagaacaauggaugauuaucgaacgacuacucgaagaagaagacucagagacacugcugaccuggcucaaaauaggcuacagacucgacgacgaagcagcccuagcggucgcaaacgccaaguuacccgaggggcauggacgauucggacugucggcaacaacggcacugcuaaaagaacucaaggccgacgucuguaccuacgccgaagcagcuaaaagagcaggguuccaccacucagacuuccgcaccggcgaggucuucgaccaacuaccguacuauggcgaaauccuggccagagaaaucgccccagggaagcccgaguauggcgacgagaaugagcgaagguucggaaaaauaacaaaccccacgguacacaucggacucaaccagcuaacgaagcucguaaacgcgaucauuagacuccacggaaaacccgacuauauauucgucgagcuggcccgcgagcuaaaacuaaacgaaaaagagaaaaucgccuacaaccggcaacuaaaagaaaacaccgacgccgccagagacaggggagcaaaacuaggaaccaugggaguuagagacacagggaggaacagauuaauacugcgacucuggacggaauuaaaccccggcgaugcccugaacagacggugcccauucuguggcgaacaaaucucacagaggaugauacaaaacggcgaggucgaaaucgaacacaucauaccguacagccaaugcuucgacgacgguaucggaaacaaaguacuaucccacgugagaugcaaucgccagaaaggcgaucagacaccaugggaaagguggggacaugaccccgacagauggucaauaauccaagaacaaguagcccaccuccacaggucaaaacaauggcgguucgggcccgacgcaagagaucgauacgccgccgaagaagauagcuucuugccacgccaacuaauagauacacaguaccucacccguauagcagccaaauaccucgcaugcuuauaccccgagcgaggcgaacgccacguauucgcaguccacggagguaugaccgcuauguuaagacgacuaugggaccucaacucaauacuacuagaccacaacuggguggagaacuuaaacagcaacgccccgaaaaacagacucgaccaccgucaccacgccaucgaugccgccguaguaggcaucaugacaccugggcugauagcagaaaucgccaaagcagccgcacgcgcagaaaaacaaaaucuagaccgauuauucgaagaacugccuaugcccugggcacaacaucccaacgaucgaagguuccgcgacgaacugagagagaaaauacuugcagcgacaguaucacacaaggcggaccacggaagacaagggaaaccagaaagaggcagggacauaacugcgggcaaacuccacaacgacacggcauacggauuuacaggccugaccucagacaccgggcuacccgucguaguacaccgagucccgcuaaccagccucacaccgaaagauauagcggaucccgacagaauacccgacaccacccuacgagggagcuuauggcaagccaccagagaccuauccgguaaggaguucgaaaaagcccuacuagacuucucucgaacgcacgcucaauucaaaggaaucagacgcgugcgaguacgagaaggccuaacacuaauaccaauaagaaaccacgcaggaaagcccuacaaaggcuaccuaggagacagcaaugcccgauauaacguauggcagaugccggacgggcgauggguccaucaaguaaucucaacauucgaccuacaccaaccuggcuucauagaacagcgcccacacccagccgccaagaagguacuaucacuacgccaaaacgacuuaauagcuaucgaacgagacggagcccugcgacaaauaaugcgaguucaaaaauacgggcagaauggccaaauauuuuuaaucgaacacaacgaagcaggcaacauggcagaaagaaacaaaaacacggacgacccauucaaauucuacggaccaggcgccagcgcccugcgaaacaugaaagcuaggcagguacgaauagacgaacucggaaggauauucgaccccggcccucgcuga

SEQ ID NO: 7324 - RNA, 3213 nt, Artificial Sequence
  Cas9 variant
auggcgaaagacuucgaauacauacugggccuagaccuaggggagacguccauuggaugguccgugguacgccugaacgagggaguaccugaacaucuggaacggcuaggaguccggaucuguuccgacgggcgagacgcccaaagccacgaaccccucucagucgcgagacggaucgcgcgcggacuccgucgucgaagagacagauacauacauagacgaauccgacuaacagacguccuugucaaauauggccuaaugccagaggacaucaaagagcgaaagaaacuccaagcgcuaaacccauaccgacugcgcucagaggcccuagacaggaaacucgaaccguacgaacuaggcagaguauuguuccacauaaaccaaaggagaggguucaaaagcaacaugaaaacagaccgaaaggacagcgaauccggagcaaugaaacaagcaauauuaaaaacgcgcgcaaaaauggaagcguccggagcacgaacacuaggcgaguuccuguacuuccuuaacaaagacaaaacaagcacacaagaauacguaccagugagaaugcggagccacucggaaaagaauaagacuguauacgagauguaucccgaccgggcaauguaugaggacgaagugcacaaaaucuucgagcaacaagaacuaagccccgaagcacagacagagaucuuuaacacgauauucuuccagcgcccgcuaaagccgguggagcuaggcuucugcgaguucgaagacggagaacgacgcgcguacacggccucggucgucuuucaaaaguuuagagcacuccaacaaaucaaccaaauuuaugugcaagacgacuacgaacgcagaccccugaccaaagaagaaaaagacauccugaaacauuuccugcucgaagauuucagcgcacuugacaagaacggccugcugacuugggccaaaguaagaacccuacuaaaacuccaaaagaagaaauucaaccuagagagcgaacgcaggaaaggacuaaacgcagacgucacaaguuggaaacuaucaaacgcagccugcuucggacgagagugguucucauucucggacgcgaagaaagaagagaucguagcccucaucaccggagccgaaaaagaagaggaacuaaucgccgaacuuaaaacgaaauacggccuaagugacgaacgcgcuaaaaacacagccaacgugucgcuaccugauggcgucgcaagccucuccgccaaagcaaugaagaaauuaauacccuuucuagaagagggcaugcucuacgaugaugccgucaaacaggcaggauacgucuucucaagcucguucaaaggcgugcuccccgagaaauaugaaacauucaucgagcccgaaagcggagagugcuucgacgagcuaccauacuacggacaaguccuaagaagguacguacuuggaggagucccguccgaagaaaacaaacucuucccggaaaaauacuacggaaaaaucaacaacccaaccguccacauaguccuaaaccagcuccgcaaacugaucaauucccucguagcaaaauacggccauccgaggaaaauagugguagaaauggccagggaccuaaaacuaucgaagaaacaaaaagacgcaaucgccaaagaacaagccuuaaacgaaagagagaacaaaagaauaggcgcagaauuagaaaggcuagacauaaggaacaacuacgacaaccgaaugaaauacaaacucugggaagaccucucaaccgaucccacgaagaggagcugccccuucugcggaaaacaaauaagucaacaggacaucuucagcccggaguucgaaaucgagcaccuaaucccauuuucgagaucguucauggacggaagaagcaacaaaguccuaagcugccgaagaugcaaccgcgagaagggaaacaagaccccauucgaagccuucggcaacgacucgacacgauggaaugcgaucaugggccgcguggaaucacuuccagagaacaaaagguggaaguucgcaagcgacgcaaugagccgcuuugaacgggauggugacuugcuagcaagaaugaugacugacacccaauacauggcccguauagcaagaagauaccucugcugugccgcaaaccccaaccagguauacggaauaccuggacaacuaacggccaaacugcgcgagcacuggggccucaacuccauccuguccgaccaaaaagaaaaagacagaagcgaccacagacaucacgcaauagacgcauucgucguagccugcacagacagaggaacacuccagaaauacuccacagagagaagagacuacgcgaaacccgaaaugccaucugagaaagccccacacauuccguucgccgacuucagacugagcgacauaaaaagagucuucgacgaaaucauaguaucgcacaaaccagaccgaggaaacgcgcgugccgccauccucaagggcggaacaguagccaaacuacacgaagagaccuacuacggcaugggcggagaaggaaguaaaaagggaacguggaaacugauacaaagaauccccgucagcgaaaucaagaaagcaucagacuuagauugccugauagaccaaaaaggcacagccaacccacuaaggguacuccucguaggagccagugagucggagcaagaacaaauaauagccagcuacuucgcacgccgaggaacgcacaaagucagaacauaccgggagcgcaacaaagacguaauccuuccguucaaggacaaagacggaaaauuauacagguaugcaguauacggcuccaacgcguacgccgaaauauacugcccagaccgaggcaaaaacgccggcaaauggcaaguagaaauaaucccaaacuacugcgcgcaccagaaggguuucauacccaaauggcgacacaccgacgcccacgcaaaguugaucaugaggcuguacaggaacgauaugguagccuacgaaaaggagggaaaaaccgucaucgcccgaguaaagaaaaugggaggcaacggggugaucguguuccgcaaccaccuaaucgcaaaagaggaaggugaucgacugucauggcaggcuguaguaucgggaaugcaaagugccaacuuacggaaaaucuacguagacgugcucggaagggugaucgacccaaaaagaccuaugacccaaaacgagaccgauggacaagacaacuga

SEQ ID NO: 7325 - RNA, 3213 nt, Artificial Sequence
  Cas9 variant
augagccacuuccgacuuaaacaauuaaacuacauccucggccuagaccuaggaauagccagcguagggugggcaguaguggagaucgacaccgaggaaaaucccacuaggcucaucgacgucggaguacgcaccuucgaacgcgcggaagugccaaaaaccggcgauagccuagcagcugcgcggagacaggcucgcuccgcccggcgacuaauacgccgacgcacccaccgccugcuacgcgcacgacgacuccugaaacgcgaggggauccuccaugccgacgaccuaaacgcggaaggccucguaaaagaacuccccaacacccccuggcagcuucggguagacggccuagaccgcaaacucaugcccaaagaaugggccgcaguucugcuacaccuggugaaacaccgcggcuaccucucccaacgcaaaaacgaauccgaaggagcugacaaagaacuuggacgacuccucgcuggagugcacgaaaaucaccaggcacuacaaagcuccgaguacagaacaccagccgagcuggcggucaagaaauuucaagcgcaguccgggcacauccgcaaccaacgcggagacuacacccacaccuucgacaggaaggaccuacaacaagaguuacaccaacuauucgccgcccaacaaaaauacggcaacccguuugugucggacggccuuaagcaaggcauagagacccuccucaugcaacaaagacccgcacucucaggagacgcaguucagaaaaugcugggaaggugcacauucgaaacggaagaguucaaagcggccaaacacaccuacagugccgaaagauucauauggcuaaccaaacuaaacaaccucaggauacaagaaaacggcaacgaacgcugucucacugcccaggaacggggccagauaaucgaccucccauacaagaaagccaaacucacguacgcccagguacggaaagaacuaucacucccggaaaaugcguucuucaaaggacuacgguauggaaaagagaacgcagaaaccgcugcccuaauggagaugaaggcuuaucacgcaaucaggaaggcacucgaaaaagcaggauuaaaaacagaguggcaaggacuggcgugcaagccggaacuacuagacgcuaucggcaccguauucucacuguacaaaacagacgaagacaucagcacccgccuucaaggacaacugagcgaagacgucauaaacgcacuccucgcuggacucaacuucgacaaguucauacaacugagucuaaaagcccucagcaaaauacucccucuaauggaacagggccaaagauacgacgaggcccacgcagcauuauacgugcgcagcacaccccaaccccaaagacugcuaccgcagauaaccgccgacgagauauguaaccccguaguccuaagaacguuaucacaggcacgcaaagucaucaacgcuauuguacggcgguacggcagcccagcaaggauacacauugaaaccgguagagaagucggcaaaucauucaaagaccgccaagaaauccaaaaacgccaagaagacaaccacaaagaacgcaaacaagccgccgaaaaauuucucgaguauuuuccaaauuucguaggacaacccaaggccaaagacauccucaagcuccgacuauaucaacaccaacacggacaaugccucuacucagggaaaacucuggacaucugucgccucaacgagaaaggcuacgccgagauagaccacgcgcucccauucucacgaaccugggacgauuccuucaacaacaagguccuaguucuggcaggcgaaaaccaaaacaaagguaaccagaccccauacgaauggcuaggaggggcauccaacucgccccgauggcaggaguucguagcccgggucggcagcagccgcuuccaccacagcaagaaacaaagaauccuccugaggcagcuugacgaggagggauuuaaagaacggaaccucaaugacacccgauacguagcccgguuccuaugcaaauucaucgaggaaaacaugcugcucuuaggcagaggcaaacgcagaguuuucgccucaaacggacaaaucacuuccuuccuucgaucccgaugggggcuccgaaaaguccgagaagaaaacgaccgccaccaugcgcuagacgccguggucguagccuguagcaccguugccauacaacagagaaucacuuacuuugugaggcaacgugaaaugaacaucuucgacggcgaacugauagacaaagaaacgagcgaaguaucccgacccuacuucccccagcccugggacuucuucagacaagaagugaugaugcgcgucuucggcaaacccgacggagaucccagcuuccccgaagcggacaccaaagaaaccuuauguacacuacucgaaacacgacucagcucccgcccgcaagcgguacacgaauacgucacaccccuauucguaaguagagccccgacccgaaaaaugagcggucagggccacaaagagaccgucaaaucagcaaagcugcuacacgagggaaaauccguccuccgcguaccccucacccagcuaaaaccuaaccuacuggaaaagaugguuaaccgcgaccgcgaaccccaacucuacgaagcacuuaaggaaagacucgcagccuacggcaacgauccugccaaggccuucgccaccgaguuccgcaagaaaggcggccaacuggucaaagcaguacggguagaagacacacagaaaagcggcguacuacuacacaaaggcacaggagucgcugacaacgccacaaugguccggguagacguguucgaaaaauccggaaaauacuaccuagugccgauauauagcuggcaaguagcccagggaauacucccaaacaaggcggugauccaagguaaagaugagaaaaacugggacgaaauggacgaaaccuacaccuucaaauucucaauguaucccaacgaccucgucgaaauaaacacagguaaacaacggcuguucggcuacuacaucggacuagaccgcgcaacuggagcgauauccauccgcgaacacgaucuagacaauuucaaagggaaaaacggaauauacagaguaggcgucaaaacagcgaucucguucaagaaauaucagaccgacgagcugggaaaaguagugguuccuugccggcccaagaaacgacucccaguccgcuga

SEQ ID NO: 7326 - RNA, 3216 nt, Artificial Sequence
  Cas9 variant
augcggcuaggccuagacaucggaacaaacagcaucggaugguggcuauaccaaacagaugacggcacaauaaccgacguacuggacggaggcgugaggaucuucucagacggccgcgauccacaaucaaaggaaucgcucgccgucgacagaagaguagcccgagcacaacgcagaagacgagaccgcuaucuaagacgaaaagcugcacuuaugaagcgaauggccggcgcaggucucaugccaaccgaccaagcucacgcgaagaaacucgagucacuagacccuuacgcccuucgcgcagaaggacuugacugcgaacugcccuugacacaccucggccgagcauuguuccacuuaaaccaacgccggggguuuaaaagcaaccgaaaaacagacaggggcgacaaugaaagcgggaaaauaaaagacgccacggcgcgacuagacugggcgaugagagacgcaaaagcccgaacguacggcgaguuccuccauacacgacaacaaaaagccgacgacccgaaaagaaugccaacaguaagaacaaggcuaacagucgcgcgccgagacaaugcugaaaaggaggaagcaggguacgauuucuacccagaccgcagacaccugucagaagaauuugaugcacucugggccgcccaagcugacuaccacgaagcccugagcgacgaccuaagagaucagaucaaaacaaucauauuccaccagcgaccacucaagacacccgaaguagggcuaugccuauucacagacgagcgcaggauacccagcgcgcacccccuuaaccaaagacgcaucuuacuagagacagucaaugcccugagaauagucgcacgaggcgaggcggcccgccgacuaacacuugaagaacgagaccaaauaguccacgcccuagacaauaaaaaccacaccaaaacccuauccgguauggcaaugaaacucaaagcacuagggaaaguaauccgccugaggagcgaccaaacauucacgcucgagacagccaauagagacgccauagcaugcgaccuggugagagccagccugagccaccccgaccgcaugggcggaguuuggaccacccucgacgaaggagcacaaugggaagucguacagagaauuagggcgguccagucggacuccgaguucgaugcgcucgugguguggcuagaacagaaccauggacucgauaacgcacacgcccaagcgacagcaaacgcaccguuaccagaaggauacggucgcauggggcuaauggccacgcgccggauucuugccgcucuccagagcgacgugaugcccuacagcgacgccgucgcagccuguggguggucacacagcggcggaccaacgggcgaaguccuggaaaaacuacccuacuauggaaaaauacuugaccgacacgugaucccgggcacauacgacgaaaacaacgaagacgugaaaagguacgggcgcauuacgaacccgacaguccauauuggacuaaaccaaauacgaagacucgucaacaggaucauaugcauacacggaaaacccgacgaaauuguaguggaacuggccagagaccugaagaacagcgaagaccagaaacgggagauccagaaaauaauaaagaaaaauacggaugcagcaauaaaacgcggugaaaaacucauaaacgaacuaggacaaaaagacaccggcgcaaaccgcuuagucuuaagacucugggaagaccuaggccacgauguaaugaccaggaacugccccuacagcggcaaacggauaagcgcaggcaugcuauucgacgguuccugcgacguggaccacauucugccauacucacgaacacucgacgacgggauugccaacaaaaccuuaugucuuaaagaggcaaaccgacaaaagucaaacaacacccccugggaaguauggggagaaacggagcaaugggacaccauagcggcuaaucucaaaaaccuacccgacaacaaggcauggcgcuucgcuagcgacgcaaugcaacgguucgaaggcgaaaacgacuucagcgcacgugcacuaaaggacacacaauaccucagccgaaucgcccgggcguaccucgacgcccuguacgacggcggggacggaaacucucacguauggguggucccgggcagacuaaccgagaugcuccggagacacuggggauuaaacggacuggaagcccucacagacagcgacgaaaacaccguaaaagccaagaacaggauggaccaccgucaccacgccaucgacgcggccguagucgcagccaccgaucgaggccucauacagcgaauauccaagaucgcgaaaagggacgaacaagcgggagccgaagaaguugcaagauccgucuccccgcccugggacggcuucagagacgacauagcagcccaacuaagucggauaauagucucacaccgagcagaccacggaagaauugacagccaggcaaaacaacaaggagaggaugcgacagcaggacaacuacauauggacacggccuacggcgucguagacgcagggcgcguaguuagccgaaaaccccugcugucacuauccgaaucagacauaaagaaaauaagagaccccgaucuccaaagacaccuaacucgcguaacaaaaggacucgauaagaaagaauuugaacacgcacugucagacuucgcuaacgccaggaaacuccccgaccaaagcgaaaacccauacuucggaaugcgccgcgugcgccucauugacgcacuacaggacucagcaaggguaagcguacgagaccgagacggccacauauauaaggcguacaaagcgggcagcaaccauugcuacgaaguauggcgacuaccagacggcaaaauaaaaccaugggcgauaagcacuuucgaagcgcaccagaccgguaccgaaagcaaaccucacccagccgcgaaacgacuccuacgagucuucaaacgcgacauggucgcgaucgaacgcgauggagaaacacugaugugcuauguacagaaaauggacaucgcaaacggccuauuccucguaccccacacggaagguaacgccgaugccaggaaccgagauaaagacgacuccuucaaauucauacaaaugagcgcggucagucucauacgggccaagauccgacgcauccacgucgacgaaauggggagacugcgagaccaagggcccccaagauga

SEQ ID NO: 7327 - RNA, 3216 nt, Artificial Sequence
  Cas9 variant
augcgcuacaccaucggccuggacaucggaaucgccagcgugggcugggccgucaucaacgaggacaagucccggaucgaggaccucggggugcgcguguucaagaaggcggaggagcccgacggcaagagccugaaucuggcccggcgcgaggcccgggggagucgccggcgcauccggcgccgggccacccgcaugcagaaggucaaagagcuccuggugaaguacaaccuggugucugagaaggagcucgagacgcuguacaucaucaccgagaccaccccagacgucuacgagcugcgggccaagggccucgaccgccugcugucccggcaggaguucgcgcgcgugcucacgaacaucgccaagcggcgcggcuacaagagcaaccggaagaucgacgaggaggacaaggagguggggaagcuguccaagggcaccaucgaaaacaagcgcauccugcaggagaagggguaccggaccaucggagagauguucuacaaggacgagaaguucgaguacaacaagcgcaacaaggccggugaguacaacagcaccguccuccgguccaugcugaucgacgaggugcacacgcucuuugagaugcaacgcaaguucaaaagcgaguucgccaacgaggaguucgagaaggaguacguggaggucaugaccuaccagaagcccuacaucacccccgagcuccuggagaagaugcugggcaagugcaccuucgagaagggcgagccccgcgcgccgaagaacuccuacacguucgagcgguucaugcuccugcagaaggucaacaaccugaacaucuacaucaauggggagaagguggagaucccccaggagaagaagaaggagaucaucgagcucgcguacaagcagagcgagaucaaguauacccagcugcgcaagaagcuggagcuacccaucgaagcccgguucgccgaccugaacuaccagaucaagcgcaccgaggacgaguccgaggaggcccuggucaagaagaucgaggacaaaaaguucgugaagcucgaaggcuggcacaagauccggcuggcgcugaaggagaacaaggacaaguucgagaagaucgagaagaaccccgagcuccagaacaucaucgccgacgcccuggugcgcaacaagaccgacgagacgaucaagaacuaccuggagaaauccgacaucgacgaagaaauaaucaacgccauccucaacaucaacuuuaccaaguucgggcaccugagcuacaaggccaugaauaagauuaucccggagcuggagaagggccucacguacgacaaggcgugcgagaacgucggcuacgaguucaaggggcggaagaacgagcugcaguacaagcuaccgccgguaaccgagcucgaggacgagauccugaacagcgugguccugcgcgccguuucccagacccggaaggugaucaaugccaucaucgacaaauacggcagcccaaccgccaucuacauagagaccgcccgcgagcucuccaagcccuacgacgagcggaugaagaucgagaagcgccagaaggagaacgcggccaacaacgaccagaucaaggaguacaucaaggagacuuucggcuucgaccccaagcccuucgacaucgucaagaugaagcuguggcgggagcagaacggcaagugcgccuacucaagcaagcccaucccggccgagcgccuguaugaggagaacuucgugcaggucgaccacaucauccccuucagccggugcuucgacgacagcuaccagaacaaggugcucgugcugacggacgagaaccagaagaagaaggagcgcacccccuucgaguacuucggggaggacaaggagcgguggcaccaguucgaggaguucgucaaccugaccuauaaguucaacacccgcaagaaggagaaccugcucaucaagaacuucaacgaggagaaguccaaggaguggauccagcgcaacaucaacgacacgaaguacaucagcaaguucauguacaacuacaucgccaacaaucugaaguucgcggacuccgagagcaagcggaagguguacaacaucaacggccaggccaccuccauccugcgccacuacuggggccucaagaaggaccgggaggagagcgacaagcaccacgcccaggacgccgugaucaucgcgugcgccaccaacaaaaacauuaagaaggucuccgacuacagccgccggaagcugcuuuacaagaacaacgagaucaucgacgaggagaccggggagaucaucgacaaaaaguacaacaucgacaucuccauaaaggagcccuggccgaaguuccgcgaggagguggaggcccggauggaggacgccgacaacaacggccagcucuacgcccugaucaacgggaacuucacgaacuacgacgacguggacaucacccacaucaagcccaucuucaccagccgcaugcccgagcggaagaucaccggccgcgcgcacaaggauacgaugcggucgcagaaguucauccagcaggggcagaacuucaccgucgugaagaagccccugaaggccauuagcaagcaggagaucgagggcaucaucaacaacccggacuucaagaaccucuaccugucagacaagaagcuguaugacgauaucuaccaaaagaugaaggaggcggacuucaaggccgagaaggccuucgcgaacgaguacagaaaauacagcaagaacggcaacucccccaucgugcggagcauaaaggucgccuccgccggggccaccggcgugcagcucaagaacggggccaucgcggagaacgccaacauggugcgcgucgacguguucgagaaggacaacaagaacuaccuggugcccaucuacgucagcgacuucgccaagaacgagcugcccaacaaggccaucugcgcgaacaaggacgaaaaggaguggaucgagaugaccgagaaguacaaguucaaguucagccucuacccuaacgaccuggugaagaucaagcggaagaaugagaaggaguucuacgccuacuacugcuccacccaccgcggcacggggaacaucaaccugcuccuggugaacggcgaggcccggaaggacggcgucgggaucaagaacaccgagaucuucgagaaguaccagguggacgugcugggcaacaucagcaaagucaacaaggagaagcgcgagggggugaaguga

SEQ ID NO: 7328 - RNA, 3216 nt, Artificial Sequence
  Cas9 variant
auggacuaucggaucggucuugacaucgggacgaauagcauaggcuggucgaucauugaacucacgacgguccagagcaaacuugacggaaaauaccgccucaaagccgucgguuugaucgaugccggggugcgaauguucgaccgcgcagaaguccccaaaaccggcgccagccuggcccugccccgcagacucgcacggagcucccggcgccgccugacccgacggucggcccggaagaaggcgauccgcaaccugcucgucaaggaagacauucugaaccagauagaacuggaccaccuauaccgcacuuccgaguuggucgauaucuggcaaauccggguagagggccucgagcgccgucuugggcgccaagagugggcacgguugcugauccaccucggccaaaagcggggguacagaagcacgcgcaaggccgaagagggcgccgacacagaagggcgagcgguacuuuccagcaucaaggaaaaccaggagacccugaagcaauaccggaccgugggcgagaugugggccacggacgacaaauucaagggccgggucagaaacagcaccaacgaguucaucuucaacguuagccgcgacaaccucgaagaagagauucgguuucuguuccaacaacagcgcgagcugggguccauguacgcuagcaagcuccuggaggagucuuauauggagguguggggccaccagcuccccuucgccagcggggaguccauccucaagaacguggguacaugcagcuuguacgagaaggagaaacgggccgcuaaggccacguacaccuuccaauacuucauggcgcuggacaaacucaacaauguccgcaucuuacccucaaugcggacgcugagcgaggaagaacgcgggcuugcccuaaaggcgauguuugagcgggacaaacugcccaaaaacccgcccaaauucaccuauucacaccuccgcaaggcgaucaagcuggaggaggacgagaccuuccagacgaucuccuacgacguggagaagacccuugccaccaacgagagcgcgguguuugucaaccuugcugccuacuaccaaaucaagaaggugugcgacgaacacaacgaaaacuacgacuacguggacuacaacacuaucgggcacgcacuaacagucuacaagaccgacgaggacauaaacaaguaccuggcauccaaaaacaauauagcaaagcggguguacgcuaacgacuuuaucgauagcgugcucaagcacuccuacaccaccuucggucaucugucccugaaggcucucucccggaucauccccuuaauggaggagggggagguuuucgcgaaggccaaggagaaggcuggcuucaaggaagagagcuaccuggaaaucaaaucgaagcuccugacgaauauuccggacgcaaucaagaaccccguagugaugcggucucuaacccaggcgcgcaagguaaucaacgcuaucaucaagcggaugggggaacagcccgccuccauucagaucgagcuggcccgcgagcucucgaaagaugugucugagcggaagaagaucacgaacggauuugccgagaaucgcagccguaaucaguucgcuaucaagacccuggaggagaaucacaucacgaacauucggggacaggacauuguuaaguucaaacucuggcaagagcaagggggucguugcgccuacucacuaaagcccaucaagcucgaggagcucauuagcuuccugaaaaaggagcggcgcuaugagcacaaccuagacguggaccacauaauccccuauucaaagacuuucgacgacagcuacaccaacaagguguuaguuuucucugacgagaaccggaagaagggggaccagaucccagccgaguaccuuggcaucgggaccaaacgcugggagaaguacaaagaguucgugaucacgucaaaauuccccgccagcaagaaaaagcggcucuuaaaggaacagcucguggagcgcgaggaauuauucaugaaagagcggcaccugaacgacacacgauacgccucacgauacuucaugaacuuucucagggagaaucuguugcggaaggagaccguccuccacgaaacccaguggguaacggcgguggccggccgcgucaccagccacaucaggaaacgacucgguuuuggaaaggaccgggaggaaacucaccuccaucacgcccuggacgcaaucaucguggccugcacagacaaguggaugaucgacugcgugacaaacuacuacaaaagccgcgagggcggaagcauaaaacggaaggagaucagauuccccaguccauggaacggcuucuggcaugacguccagacgaagcuggcacaacuaccgcagccagaggugaucaaugagagcaucagcaaagggaauccugacgccguggauuacaugcucgucagccggaugccucgcaagucuaucaccggcgcugcgcacaaggagacgaucagcaagugggguggguacgacgauaaggguaaggcuuugcuggugaagaagguggcucuguccgagcucaaguucaaaaacgacgauuuuccgauguacaacaaggagacggauccgcuccucuaugaggccaucaaaaaccguuacguugagagcgggagggacgugaaaagagcauucgccacacccuuauacaagcccuccaaguccggcaagcggaacgaggugaagcgcgucaaggucaucgcggaaaagaaggccauggugagagaggucaacggcgggaucgccgagaauggcggacuggugcgauccgauaucuuccucaaagagaagaaguacgugauggucccaguguauaccuucgacaccaucaaacaacaacuucccaacaaguacguggucagcggccggggguacgagcaauggcccgaguugacugcagagcacguguuucaguucuccguguacccuuacgagcucguccacguaggcacgaacaagggugacaacagcuucuacuacuucgcuucccuuaacauuuccucuaacguacugaaguucucugagugcaaucgcccgaccaaggacuacaucgagaucgggcucaacagcaucauccugcuagagaaguacgagaucgacguccuaggcagaaucaccgggcaguccaagaaaggcauucgccagagcuucaagaauaacaagucccagaugaaagaguga

SEQ ID NO: 7329 - RNA, 3219 nt, Artificial Sequence
  Cas9 variant
augagacucgggcucgacaucggcaccaacagcgucggaugguggcucuauaagacagacggagaagccgccucagcacgcauagucgaaguaauagacgggggaguacgaauauucagcgaugggcgagacccaaaaucaaagacaucacuggcggucgacaggagaguggcccgagcagccagaagacgacgcgacagguaccuccgccgacgagcaucucucaugaagcugcuagcccgcacgggacucaugcccgcagauccagucgaagccaagaaacuagaaagacuggacccauacgaacuacgcagcaccggacucgacgacgcacucccacucacacacuucggaagggcccuauuccaccuaaaccaacggcgaggauucaaauccaaccgcaaaacugaccggggagauaacgaaaacggcaaaauucgcgaagcaacagcucgacucgaucuggaaaugaugacgucaggcgccaggagcuauggagaguuccuccacaugcgccgacaacgggcauccgacccacggcacguacccaguguacgaacaagacuaagcguagcagccagagggggaccagaugccaaagcggaagccggcuacgacuucuacccagacagacaccaccuggaggaagaguuccacgcacucugggccgcacaagcaacacaccaccaggcacucacagaugaccucagggaccuaguauucgagaaaaucuucuaccaacgcccccugaaagaaccaaaaauaggccuuugccuuuucaccgccgaagaaagaauagcgaaagcgcacccacuaacacaacgccgaguucuauucgaaacaauaaaucaacuacgaguaacggcggacggaagaucgacaagaccacuaacccuggaagaacgagacacgcuggugcaugcacuagauaacaagaaacccaccaaaucgaugaccagcaugaacaugacacuaaaagcacuugcaaaacuccuaaaacucagagacggagaaagauucacccuagaaacaggaguaagagaaaacauaagcugcgacccgguccgcgcaugcauggcacacccggccagguucggcccccaauggucaagccucgauugggaagcacaaugggacgucauaucgcgaguucgccaaguacaauccgaaggggaguucauagaacucacagacuggcucauacaaggacacgggcuagacgccgaucacgccaaagcagugggaaacgcgccccuaccugaaggguacgcuaggcucggauucagugcaacggaaagaauacuggaccaacuuaaagcagaagugugcaccuacagcgacgcgguagcuaaguguggguggcaccacagcgaucaacgcacgggcgcaugccuugaaguccucccuuacuacggcgagguacucgaccgccacgucauacccggcacguacgacgcgacagacgacgaaaucacaagauacggaagaauaaccaacccgacaguacacaucggacucaaucaacuaaggcgccuaguaaauaaaauaaucgagguccacggaaaaccagaccaaaucguaguagagcucgcacgugaacucaaacagagcgaaccccaaaagaaggacgccaugaaacggcuacgcaacaccaccgcggacgcaaucagaagaagugaacaguuagaacaacucgggcaacccaauacaggccacaacagaaugcuccuucgacucugggaggaccucggcccagcaaucggaccgagaugcugcccauacaccggaaaaaccauaagcguaacgaugguauucgacggaagcugcgacguagaccacauacugccauucucccgcacccucgacgacucauucgccaacagaacccugugccuaaaagaagcaaaccgagaaaaaucggaccgaacacccugggaagccuggggaggcacagaccaaugggacgauaucgcagccaaccugaaaaaucuacccgaaaagaaacgcaaaagauucggaccggacgcuauggaaugguucgaaggggagaacgauuuccucgacagggcacucgucgacacacaguaucucgccaaaaucagcaggauguaccuagacacacuguucacaaaaggaggccacguaugggugguccccggccguaugacagaaaugcuccguagacacuggggccugaacgcacuccucaacgacaaggaccgaggagccguaaaggcgaaaaaccgcacagaccaucgccaccacgcaaucgacgcugcgguaguagccgcuaccgacuacaggcucaugcagaaaauuagcagagcagccggacaaggagaaaacgcaggacaaagcgcggaacuaauugcacgggacacggaugcaccaugggaacacuuucgcgccgacauagccagccaacuggagaaaaucauagugagccaccgggccgaccacggccguauagacguagaaggacgaaaaaccgggagggacucuacagcagggcgccuacacaacgacacggcauacggcguaaucgacgaccugacaguggccucaagaacaccgcugaugagccuaaaaccaagcgacauagcaauaacagagagagggaaaaacauacgggacccgcaacuccaaaacgcacuauacgucgcaacaaagggaaaagagggaaaaauguucgaacaagcccuaguagacuuugcgucaaaagaaggucccuaccaaggcauaagacgcgugagacuuguggaaacccuacaaaaagcagcucggguagaaauaggcaaaaccgaaucaggacaaccccucaaagcguauaaaggagacucaaaccacugcuacgaacuauggaaacuaccggacggaaaaauugugccccaagucguaaccacguacgaagcccacgcgggaagcgcaccccgcccgcacccagccgcgaaacguauccuaagaguguucaagaaagacaugguaaaacugaccaaagacggugaagaaauugucggcuacguacaaagcaugcacaucaaaaacggacucuucgucgcacaacaccuagaagccaacgcagacgcaaggaacagagacaaaaccgacccauucaaauuccuucaaaugggcgcaggaacccucguaaagaccggccuacgacgaguccucguugacgaaauagguagacuccgagaccccgguccgcccaagcuauga

SEQ ID NO: 7330 - RNA, 3225 nt, Artificial Sequence
  Cas9 variant
augcaaaccaaaaaccuaccauauacccuaggccuagacaucggcauggcgagcguaggugcagcacuacuccugccagaccaagaacgcauauuagcacuacacgucagaacuuucgacaaagccgaaacggcaaaagaaggcgaaagccugaacaaaauccgaagagacucucgacuaacaagacgaaggaucaggaggcgagcgcauaggcucgugcgccucgcgcgacuuaugaaaagaguaggacucauagcagacgcaaaucccgaagccuuugcacuaccaggagugucccccuggcaccugagagcugacggauuagaucgccugcucgagccaaaggagugggcaggaguccuauaccaccugguaaaacauagaggauuccagagcaacagaaaaagcgaagccaaggccgacgaaaaagcagggcaaaugcucagcggcguaggccggaaccaggcauugcuaaaggaagccggcuaccgcacagucggggaauuagccgcccgacaugaggacuucaaagaagcaaaacgcaacaagggaggaagcuacagccacacauucgccagagcagaccucaacgcugagcucaaccuucuguucgaacgacaacgagcacuaggaagcaggcucgcaagcgcggacuuccaggaaaacguaagagaccuccuaauggcgaggcgccccacccuaagcggcgcaaaucuacucaagaugguugggaaauguaccuucgagaaaagcgaagaccgagcgccaaaagccggguaccgcgccgaacgauucgucuggcuaggcaaacucaacaaucucaaaaucguuggaucaggggacgcacgcccccugaccgacgcagagcaccgaaucgucauagaccuuccauucacacaagcaaaacucaccuuuaagcagguacgcaaggcacuagaacuugaaacccaccaacgcuucaauuuacugucauacaggccagacccgaaagggaaggacaaagaucccgaagaaucaacauucuucgaggccaagagcuuccacacacuccggaaagccuaugaaggcgccggccuaaagaaagaguggcaacgggacgcccuagaucccgacagacuagacgcacucgcguacgcgcuaacaugcuacaaagaugacacugaaucccgccagugguuagucgcgcaaggaauaggaacaccgaucaucgaagcaguacuagccgaaucauucgacaaauucauucaccucucccaaaaagcgcuaaaagccauacucccacacauggaagccggacaacgcuacgacgacgccgcgaaaucagccggauacgaucacucacaacccgacgccgggaccggcaagagggcaacccugcccccacccgacaaagauacgauccgcaaccccguugucuaccgagcccucaaucaggcacgaaaacuugugaacgccauagucgcugaauacgggcccccagcagcgguacacaucgaacucgcgcgagaccuaucaaaaccaauagacgaaaggcgcgauaucgaaaaagggcaaaaagaauuucaagcacugaaagaaaaacuagcagcggccuucgaagaaacauuccaccgaaaaccaucaggacuagaccuauuaaaauaccgacucuuccgcgaacaacuggaccaaugcccuuauugccaaaaggcacuuguaguagaccgacuauucgaaccugguuacgcccagaucgaccaugcgcugcccuacagcaggaguuucgacgacgggaugaacaacaaaguaguaguccaugucgccugcaaccaagacaagggaaacagaacaccauacgaguuccuggacggagccggagacagcgaaagguggcaacgcuuugucgcguggguacaaggaaacaaggcgauccgacaagccaaacgcaaccggcuccuacgaguaaauuucggaacagacgaagcaaaggaguucucaaaacgaaaccuaagugauacaagguacaucugcagggaauuuaaacgcaccaucgaaacacaauucgcauggcacagcgacgccgaaggaaacgaacgaugcgucguacugagcggccagcucacgagccugcuaagggcacggugggggcuaauaaaaguacgcgaggacggggaccuccaucacgccuuagacguagcuguuauagcggcggcgagccggagccuagucaaaagaauggccgauuacucacgcaggaacgaacuagagauggugcgcaaucgcuacguagacccagccaccggcgaggugguagacgucgcagcccuccgccaaaucgaagaccacuucccaaaaccauggccgcucuuucgagaggaacuacuagcacgccuagcaccggaacccaaauugcaacucacaugcgucucauccuacgacgaaggccuacgagaaagcauacggccgauccgagugagccgcgcacccacaaggaggggauuaggcgccgcacaccaagagaccaucagaagccucagagacggcagccagucagcaaucaagacaccccucagggacuugaaccuuaaagacuuggaaaacauaguaggguucgaacgcgacaccgcacucaucgacgccauaagaaccagacuugaagcauucgggggugaagggaaaaaggccuucgaugacaaacagccaccccuacggaaacccucgaaagacccggacaaagccccaaucauacguaguguaaaguugcucgucacacaaaaauccgguauccccauaaggggaggaaucgcaaacaauggagccauguuaagauccgacauuuucacaaaggcgggcaaguuuuaugccguuccaaucuacgucgccgacgcaguacgcggcgagcucccgcaccgagcagucgcacaagcuaaaccagagcucgaguggccaaugauggacgaaaguuaccaauuccuauucucacuacaccccaacgacuggaugacuauccggcuaaagaaugagguacgagagggauacuacgccggacuagaccgggcaaccgggaacauaagccucuggcuccacgaccgaaaccaaaacgugggacaaaaagggcuacucacgggaaacggcauaaaaaccgcucucgcaguggagaaguaccacgucgaccuacuaggaaaacuacaccgaguucacaaagaagaacgccaacccauacacaucaaaccaggcaagcgauga

SEQ ID NO: 7331 - RNA, 3234 nt, Artificial Sequence
  Cas9 variant
augaaguacagcaucggccuggacauugggaucgccuccguaggcugggccgucaucaacgaggacauagagcgcauagaggaccucggggugcggaucuuugacguggccgagcagcccaagacuggcgccagccuguccaccccgcguagguuggcccgcagcacgcggaagcgccuccggcgccggcgacaccgggucgagcgagugcggaaguucaugauucagaaggggcugcugacccaggugcagauggagcagcucuacgacuggaaggacggcgaccuggacaucuggcugguccgcgugaacgcccucgagcggaagcuguccgaccgcgaguucgcccggauccuggugcacuucgcgaagaaccgcggcuuccagagcaaccggaaguccgagcuccaggaggaggacaacggggcuguccugagcgccgugcaggagaacaagcgccugauggaggagaagggcuaccagaccaucuccgagaugcuccuguacgacgagaaguucgaggggacgaagcggaacaaaggcggggaguacacgcacguggucgcccgcagcgaccugaagcgggagauccagcucaucuuugagaagcagcgcgcuuacggccacgccuucgccaccauggagaacgaggacaaauuccugcagauaugguccagccagcgccccuuugcaaccaaagacgacauagccaagaagaucggcaacugcaccuucgagcccaaggagaaacgggcucccaaguccacguacaccuucgaacgcuuccgggcccuagacaagcucaaccgccugcggauccugagcgggaccuccccggcgcgcagccugacccaggaggagcgggacuuaauccugaacucccuguucagcaagaaggaggugaaguacaaggagcugcgcaagcugcucaaguugaacgacgagcaacgguucaaugagauauucuacgaccccaacgagaagaucgagaagaacgagaaccgaacauuccugucucucgagagccaguacaagauccgaaagauccugcagaagaucgagggcaagagccugaacgauaccuaccgcccuguggaccuagacaccaucgccuacgcgcugaccgucuucaaagacgaccaggacauccgggacuaccugcagaaccaguacguggcgaguaacgggaagaaggagcucaaccuggccaaucgcaaguacaacgacgagcugauugaggagcuccugcaccucagcuucacgaaguucggccaccucucccugaaggccuuaaggaacauccuccccuucauggagcagggcauccccuaccaccaggccugcgagaaggccggauaccaguucaacaagaaggugaaccgcgagaagcagaagcugcugccgcccguccccgccaaggacaucgugaaccccguggucauccggagccugucccaagugcgcaaggugaucaacggcauaaucaagcgcuacgggagccccuccagcaucuacaucgagcucgcccgggagaugggccgcggcuacaaggagcggaaggaccuggagaagcaguacaacaagaaccgccagaugaacgagggcgccaagaaacacauccuggagcucaggcccgaguucggcgacccccgcgggcacgacauucugaaguauaaacuguggcaggagcaagacugccggugcgcauacuccuucaagagcaucccgaucaagcagcuguucgagaucggcuacgccgaggucgaucacaucauccccuacucccgcuccuucgacgacuccaacaacaacaagguucucguccucgcggccgagaaccagaacaagcagaaccggaccccuuacgagugguucgggcacgacgagacgaaguggcaggaguucaccagccucgugacgaccaugaagguguccaagaagaagaagucccugcuacucaagaagaacuucgaugaggagcaggccgaggaguuccgcagccggcaccugaacgacacucgcuacaucacccgguacaucaagacguucaucgaggacaaccugcaguuccgcaucgaggagggcaagaagaccuacguccacaccgugaacggggccuacaccagccucaugcggaagcgcuggggcuucaacaagaaccggcaagagaacgcacugcaccacgcccuggacgccgugaucgucgccguaucccuccccuucaagcacaaaguucgcgccuacuucaagcgucgcgaggaguacgcgcacaaccagcugaagcgggagggcgaguucuucccugagcccuggcccggguuuauccacgagcuagagauccgcaugaugcaggacagcgagaacaucaagcucgccauggaaagccucaaccugaaaacguacgacgaaucguucauuaaggagcucaagcccaucuuugucagccgaaugccgaaacgggccaugaagggccagauccacgaagagacccugaagcgagugcgggggcgcaccgacgauggcuacauccggaccgugaagaaggucaagcuagaccagauccccuucgacaagaacggggacuuccccauguucggcaaggagacggacaugaaaaccuaugaggcaaucaagucccgcuaccucgagagcggcaaagacaagaagaaggccuucaacacgccccuguacaagccggcgaagaaucccgagaacgcccccauuauccgguccaucaagaucgaggagaaggcaaaccgcguggugaugcuggacgagaagaccgccgccgacaaugcgagcaucguccggaccgagguguuccgccacaaggagaccgggaacuacuucuuaaccccgguguacgucgccgacgugcuggccaagaaagugcccgaccggcucaucaccaccaagaagcccuacucugaguggcgcaagaucacggaugaguacgaguuccucuucagccuguaccccaacgaccugauccggguuaagaugccuaaggaaaaggagaccaagacccauaccggugagaagcacguguggcaggaaaauuucauguacuucaagggcgugcacuccggcagcgccggcguccgcaugaucgaccacaugaacuccuucgaggacgaaaucggggugcggaagcucguggucuucgagaaauaccagguggacccccugggccguaugaacaaggugcacggugaaaagcggcacggcaucuga

SEQ ID NO: 7332 - RNA, 3234 nt, Artificial Sequence
  Cas9 variant
augaaauacucaaucggacucgacauaggaauagcaagcgucggcugggcagucauaaacgaggacauagaacguaucgaagaccucgggguccggaucuucgacguagccgagcaacccaagacaggugcaucucuauccacgccccgccgacucgcucgguccacccgcaagcgccuccgaagacgcagacacagggucgagagaguucgcaaguucaugauccagaaaggucuacucacacaaguccagauggaacagcuguacgacuggaaggacggcgaccuagacauauggcuaguaagaguaaaugcacuagagcgaaaacucagcgaccgcgaguucgcccgcauccucguccacuucgccaagaacaggggcuuucaguccaaccgcaaaagcgaacuucaagaagaagauaacggggccgugcucagcgccguccaggaaaacaaacgacuuauggaagagaaaggcuaccaaaccaucagcgaaaugcucuuguacgacgagaaauucgagggcacaaaacgaaacaaggguggcgaauacacacacguugucgcacgaagcgaccuaaaacgcgaaauccaacugauauucgaaaaacagcgugccuacggacacgcauuugcgaccauggagaacgaagacaaauuccuccaaaucuggucaagccaaaggcccuucgcaaccaaagacgauauagccaagaaaauagggaauugcacauucgagcccaaagaaaagcgcgcccccaagucgacuuacacauucgaacguuuccgggcacucgacaaacuaaacaggcuacgcauacucagcggaaccucccccgcacgcucccucacccaagaggagcgagaucuuauccugaacagccucuucucaaagaaagaaguaaaauacaaagaauuacgaaaacuccugaaacucaacgacgaacaacgauucaacgaaaucuucuacgacccgaacgaaaagaucgagaaaaacgaaaacagaaccuuccuaucccucgagucccaguacaaaauacgcaaaauccuccagaaaauagaagguaaaagucuaaacgacacuuaccgcccugucgaccuagacaccaucgcguaugcacucaccgucuucaaggaugaccaagauauacgggauuaucuacagaaccaauacgucgccuccaacggcaagaaagaacugaaccucgcaaacaggaaguacaacgaugaacucauagaagaacuacuccaccucagcuucacaaaguucggacaccuauccuugaaggcacuccguaacauacuaccauucauggaacaaggaauccccuaccaccaggcgugcgaaaaagccggcuaccaguucaacaagaaagucaaccgagagaaacaaaaacugcucccgcccguacccgccaaagacaucgucaacccagucgucauccgaucccuuucccaaguccgaaaaguaauaaacggaaucauuaaacgcuacgguucacccuccuccaucuacaucgaacuagcgcgagagauggggcguggauacaaagagcggaaggaccuggaaaaacaauacaacaaaaaccgacaaaugaacgaaggagccaagaaacacauacucgaacuccgacccgaguucggagacccacgggggcaugacauccucaaauacaaacucuggcaggaacaggacugccgcugcgccuacucauucaaguccauccccaucaaacaacucuucgaaaucggauacgcagaaguggaccacaucauaccuuacucccggagcuucgacgacucaaauaacaauaaaguuuuaguacuagcagccgaaaaccaaaacaagcaaaaccggacgccuuacgaaugguucggacacgacgaaaccaaauggcaagaguucaccagccuugucacgaccaugaaagucagcaaaaagaagaaaucacuccuacuaaagaaaaacuucgacgaggaacaagcggaggaguucaggagucggcaccuaaacgacaccagguacaucacccgguacauaaaaacguucauugaagacaacuuacaguuccgcauggaagagggcaagaaacaauauguacacaccgucaacggagcguacaccuccuuaaugcggaaaagaugggguuucaacaaaaaccgccaagaaaacgaccuccaccacgcccucgacgccgugauuguggcgguuagccugcccuucaaacacaaaguaagugcauacuucaaacgccgagaagaauacgcccacaaccaacugaaacgagagggcgaguucuuccccgaacccuggccgggauucauccacgaacucgaaauccggaugaugcaagacucagaaaacaucaaacucgcuauggaaagccugaaccugaaaacguaugacgaguccuucauaaaagaacugaaaccaaucuucgucagcaggaugcccaaacgcgccaugcgaggacagauacacgaagagacacugaaacgagucagaggaagaacagacgacggauauauacgcaccgucaagaaagucaaacucgaucaaauucccuucgacaaaaacggcgacuucccaauguucggcaaagaaacagauaugaaaacauacgaagccaucaaauccagauaccucgaauccgggaaagacaagaagaaagcguucaacacaccccuguacaaacccgccaaaaacccggaaaacgcccccauuauccggagcauaaaaauagaagagaaagcaaaccguguagugaugcucgacgagaaaaccgccgcagacaacgcaucaauagugcgcacagaagucuuccgucauaaagaaaccggcaacuacuuccucacgccagucuacgucgccgacguacuagccaagaaaguccccgaccgucucaucacaaccaaaaagccguacucagaauggagaaaaaucaccgacgaauacgaguuccuauucagccucuacccaaacgaccugauacgagugaagaugccuaaggaaaaaggcacaaagacccacacaggggaaaaacacguauggcaagaaaacuucauguauuucaaagggguccacaguggauccgccggcguccggaugaucgaucacaugaacagcuucgaagaugaaaucggcgugcgcaagcuagucguguucgagaaauaccagguggacccgcuagguagaaugaacaaaguccacggcgaaaaacggcacgguauuuga

SEQ ID NO: 7333 - RNA, 3234 nt, Artificial Sequence
  Cas9 variant
augcagcagaaaccacaaagauacauccugggacuagaccuaggaaucgccucuguagguugggcgugcgucugggccgacgaaaacgaacacccuacaggccuccucgacugcggagucaggacauucgaacgagcagaaguacccaagaccggugacagccuagccuuggcgcgaagacaagcacgaagcgucagaagacugauacgaagacgagcgcaccgacugcucagacucaggcggcuauuaaaaagagaaggcguacuacuauccgcagacuucaacgagaacggccugguaagaggacuaccaaucgacgccugggcccuccgcguagcaggacucgacaggaaacuaagcaacaaggaaugggcugcgguccugcuccaccucgucaaacaccgcggcuaccuaucccagagaaagaacgagacccaaucaaaagacaaagaacugggaagacuacuugcaggagucaacggaaaccgagaggcacuccagaaucguuccgaugaauaccgcaccgccgccgagcuggcagugaagaaauucgccgcagaaaacaacggaucacuacgcaacaaaggaggcgacuacagccacaccuucgaccgcaaagaccuacaaagagaacuacaccucuuguucgaaagacaacgagcccuggacaacccauucacaucaucggaaauggaggcugcaguagacgaacuacuaaugaagcagcgcucagcccuacaaggagaagccguccugaaaaugcuuggccggugcacauuugaacccagcgaguacaaagccgcaaagaacaccuacuccgccgaacgauucgucuggcuaacaaagcuaaacaaccugagaauacaauacaacggugaagagagagcgcuaagcgaggcggaacgacgccuccuacuagacgagcccuaccaaaaagcgaaacucacuuacaagcaagugcgaacuauacucgaacuacccgaaagcgccgucuuuaaaggccucagauacggucacggggaggacggacuaaaagcggaaagcgguacacugauggaaaugaaagcguaccacgcaguccgaaaagcccugaaagacgcgggccuggaaggcgaaugggagaacaggaucagaaacccagagcuccuggacgccauaggcacagcauucucacucuacaaaaccgacgaagacauacgagccaacuuagcggcauuccggcucagcgagaacguacucgaagcacuacuggcaggauugaacuucgauaaguucgugcaccugucgcuaaaagcacuagcaaaaauccucccacuaauggaacaaggaaugagauacgacgaagcgugcaaggaagccuauggggaccauuacggggcgaaagaacaagaggaccaccgucuacucccgcccuucguagcugacgacaucagaaacccagucgucuuuagaacacugacucaagcccgcaaaaucgugaaugagauaguccggagguacggcagcccauugcgaguacacauagagacaggcagagaaguaggcaagagcuucagcgacagaaaagaaauagaaaagcgacaagaagagaacaggaaggaaagagagagagcagcggcccacuucaaagaacuauuuccaaacuucgcgggggagcccaaagcccaggauauacuaaaauugagauuauacgagcagcagcauggcaagugccuguacagcggaaaagaaauagaccucagacgcuuaccggagaaaggcuacgucgaaaucgaccacgcccugcccuucagcaggacuugggacgauagcuucaacaacaaaguucuaguacucgggaaagaaaaccaagacaaaagaaaucggacaccguacgaauaccuagacggcaaaggaaacagcggagcguggcgcgccuucgccgaaagggucucaggaugucgauuucccuacgcaaagaagcaaagacuacuuacacaaaagcuagacgagaaaacagaacaaggcuuccuagaaagaaaucugaaugacaccagguacguggcgagauuccugugccaauucauagaggagaaaaugcaccuagaaggcgccggaaagaaaagaguauucgcaagcaacgggcaaauaacggcgcuacugcgcggauucugggggcuaaagaaaguaagagaggagaacgaccgccaccacgcacuagacgccgucguagucgcaugcagcucaguaucaaugcagcagaaaauaacccggcacuuccgcuacagagaagaauuagaacauauagaccgagaaaccggagaaguaauccauggauucccgcaacccugggaauuuuuccgacaggaagugaugacacgggucuucucagacgacccaguaagcgaacucgccgaaaaacuggauaguagacccgaagcaguacacgaguucguaaccccacucuuugucucacgagcuccacaccgcaaagucacaggacaaggacaccucgaaacgauacgcagcgccaaaagacucgacgagaaaauauccguaguaaagcugccgcucacgcagcuaaagaccaaagauaucgaacgaaucgugggcuacccaaacagagagcccgcgcuauacgacgcacucgcggcccgccucgcagcguucaaagacgaccccgcaaaggcauucagcgagccauucuacaaaacagggaaagacggcaaaugcggcguucuaguaaaagcggugcgcguagaaaacguacaaaagucugguuugcuuguccgcaaagacgagagcggcaagaugcagggugucgcagacaacgccacgaugguacgagucgacguauucggcaagaacggcaaaaacuaccugguacccgucuacgccuggcaagucgaaaaaggagaauugccgaacagagccguagucgcauacgcagaugaagaagacugggacgagauggacgacuccuucgaguucaaauucagccuauauccgaacgaccuagucgaagucgugacaaagaaagacaaauuuuucggguacuacagcggcuucaacagagccacgggagcaauaaacaucaaagaacacgaccucagcaaaucaaaagucaaaaacggcgucuacgaagguauaggagugaaaacggcccagagcuuccaaaaauaccaaguugauacacugggcaagacaauacgucuaugcaaaccagagaaaagaaugggguucaaaaagaaauga

SEQ ID NO: 7334 - RNA, 3237 nt, Artificial Sequence
  Cas9 variant
augcgcuacgugcugggccucgacaucgggaucgccagcugcggcugggccgucaucaaccaggagaaggagcggaucgaggaccugggggugcgcaucuucgacaaggcggagaaccccaaggacggcaagucccuggccgccccgcggcgcgacgcccggagcacccgccggacccuccgccggaagaagcaccgcaugcagcggaucaaggugcugcuggucaagcacgggcuucuguccaagacggagcuggaccaccucuacgagucagccaccgagguggacguguggaaccugcgccuggacgcgcucgagcggaaacuguaccccaaggaguuugcccgcauccugauucaccuagccaagcggagaggcuucaaguccaaccggaaggagaccacccugagcgagaacggccagauccuagaguccauaagcgagaaccagcagaucauggagaaacagaacuacaggacggucggggagaugauccucaaggacaagaaguucgagaaccacaagcggaacaagaacggcaccuacguggggaccgugacccgccagcagcugcaagacgagauccagaugaucuuccacgcccagcggcuguacaagaacgacuacgcgacggaggaguucgaguccagcuaccucgagauaugggccucccaacgccccuacgccagcaaggaccagaucgagaagaugaucggcuacugcacccuggagcccaaggagaagcgcgccccgaaggccuccuggagcuuccaguacuucgucgcgcugcagaccaucaacaaccuccggcugaucuccaaggaccgcaucgaggagcugagcuucgaggagaagaagcagaucaugaaccucgcccuggagaaguccauagugaaguacaucgacaucaggaaacuacucagcgugcccaaugaguuccaguucaacucccugucguacagcgccgacaccgucgacacggccguggagucccguaagugcaucgagcugaaggaguaccacagcaucaacaagguguacaagcagaucuacggggagaacgcccucaaccugcugcccaaauacuaugauaccauagcguacggccucaccaucuucaaggacgacaaggacauccuggaguaccugcagaacaaguacgucaacgccaagggcaagcccaucuccaacuucgccaacaagacuuacgacgacacguucauccaagcccuccugaaccugaacuucaccaagauggggcaccucagcuucaaggcccugaagaacaucaucccguuccuggaggagggccucuccuacgacaaggcgugcgagaaggccggguacaacuucaaggggaccagcuacaccgagcagacgaaguaccugcccgugaucccccagaacaccaaccccgugguccaccgggcacugucccaaacccgcaaggugaucaacgccauaaucaagaaguacggcagcccgaacgccauccacaucgagaccgcgcgggagcucuccaagacguuccaagagcgcaaggagaucgacagcauguaccaggacaacuccaagaagaacgagcacgccauccacaagcugaaggagcuggggaacaucaaccccagcggcaucaacaucgugaaguucaagcuguggaacgagcaggacgggcggugcauguacuccggcaaguacaucgagccucaccgccucuuugaggaaggguacaccgaggucgaccacauccugcccuacagccggucccuggacgacucauacaacaacaagacccucacccugggcacggagaaccagcgcaagggcaacaagaucccguacgaguacauggggaauaccuccaucuggaacgacuucgagacccgggugcagagcaacaagaagaucaacaagaagaagcagcagaagcugcuccugcagcacuucuccuacgcccgcgagcaggaguucaucgagcggaaccugaacgacacccgcuacgccacgaucuaccucagcagccugauccagcagcaccugauuuucuccgagagcucccggaagaagaaggugcacaccgucagcggcaucaucaccucccaccuccgcagccgguggggguucaacaaggaccgcaaggagggccacauccaccacgcgcuggacgccgugaucguugccgugaccuccgaccacaugauccagcgcgugacgaaguacuacaagcugaaggagcucaaccggaaccugcaggccaagcgcaugcccuuccccgagcccugggagggguuccggcuggagcucgaggcccgcaucagcccgaacacccagcaguaccugaaaggccugcgguucaagaacuacgcggacgucaaccucuccgagaucaagagcaucuucgugucccgcaugcccaagcacaguaucacgggcgagcugcaccaggagaccauccggaaguucaucggguacaacgagaagggcaaggugcugaccgccaucaagacgaagcucgaggacauccccuucgacgccaacggggacuuccccauguacggcaaggaguccgaccuguacaccuauaacgccaucaaggagcgcuaccugagccacaagaaggacaaacggaaguccuuccaggagccgcucuacaagcccaccaagagcgggggcaucggcccccugaucaaguccaucaagaucauggacacccgcacgaucgucaaccccgugaaccaggggaagggcguggucuacaacagcaagaucgcccggaccgacguguucaagaaggaggagaaguacuaccugaucccgaucuacacuaucgaccucaugaagaacauccugccccagaaggcgaucaccgccgggaagggauacgaggacuggacgaccaucgaccccagcuucaccuuccuguucucccucuucccgaacgaccugauucagaucgugcccagcaaaaacaagaccaucaaggcccggacgacagucucgaagaaggaggugcuccuccccucacugaccggcuacuucaagggggugcacuccggcaccgccgggaucacugucgagacccacgacggcagcgugaucgcuaaugugggguccaagcagcugcuccugaucgagaaguaccaggucgacgugcucgguaacuacaccaagaucaaggaggagaagcggaucggccucaccacguacaacgacaacaagaagaucgcggcgugcuga

SEQ ID NO: 7335 - RNA, 3237 nt, Artificial Sequence
  Cas9 variant
augaaacaacaaccacagcgauacauccuaggccuagaucucgggaucgccucugucggaugggcccucauccuaguagacgaagaagguaacccaaucggacuccucgacugcggaguccgcaccuucgaacgcgcugagguaccaaaaacuggcgacagccucgcacuggcaagacggcaggcacgauccgucaggcgccuaauucggcgucgcgcacaccgacuccugcgacuccgacgccuacuaaaacgagaaggcguccugucugccgcagauuucaacuccgacggacuccccaaccuaccuauagacaccuggcaacuacgaguagcaggacuagagcggaaacucaccaaccaggaaugggcggccguccuccugcaucuagugaaacaucggggcuaccuaagccaaagaaaauccgagacucaaacugaaaauaaagaacuaggcugccuacucgcaagcguagcuaaaaacuccaaacuacucucagaaaacgcaaaucaauacaggaccccugccgaacuagcagugaggcuauucgccgagcaaagcggccaucugcgaaacaaaggcggcgacuacacacacacauucaauagacucgaucuccaaaaagaauuacaccuacuauucgaacaacaacgaaccuucggcaacccauucgcaagugcggaacuacaaucaaaagucgacggacuucuaaugaugcaaaggagcgcccuacaaggagaggccguccucaagaugcuaggcaaaugcacguucgaacccagugaauacaaagcagcgaaacacacauacagcgcggaacgcuucauuuggcucacgaaacucaacaaccuacguauacucgagaacggaaccgaacgcgcccucaacgaagcagaaagaaaacuacuccuagaugaacccuauaaaaaggccaaacuaacauacucacaagcccgaaaacuauuagacaugucccacgaugccacauucaagggccuacgcuacggcaaagacucagaaggccuaaacgccgaaaacggagcacuaauggaaaugaaagccuaccacaaaauaagaaccguccucgacaaagcuggccucaagggcgagugggaaaaccgcauccgcaaccccgaaauccuagacaaaaucggaacagccuucagccucuacaagaccgaugaagacauacaggcggcccuagccgaccuccgauuaccagaaaacguccuaaacgcauuacuagcaggccugaacuucgacaaauucauccaacugucacucaaggcgcuaagcaacauaaugccacugauggaacgaggcauccgcuacgacgaggcuugcaaagaagucuacggugaccacagggcccuagccgaaagcaaaaaccaaaugcuacucccaccaaucccagcaaaugaaauucgcaacccaguaguacuccgaacacucacgcaaacucggaaggugaucaaugcaauaauccgacgauacggaucaccacaacgcguacacaucgagaccgcccgugaacuuggaaaguccuuuaaggacagaaaagaaaucgagaaaaggcaggaagaaaacaggaaggagagagaacgcgcggccgagcacuucaaagaacucuucccacacuucgcaggagaaccaaaagguggcgacauacucaagcuacgacucuacgaacagcagcagggcaagugccuauacagcucaaucccaaucgaccuaggcagacucaaugaaaagggcuacguggaaaucgaucacgcacuccccuucagcagaacuugggacgacucauucaacaacaaaguacucguccucggauccgagaaccaaaagaaacgcaaccaaacacccuacgaauaccuagacggcgccagcaacucccaaagauggagagaguuccaagcacgacugcaaggaugccgauuuucguacgcaaagaaacaacguauacaaaccgcaaaacuagacuccaaaaccgaacaaggguuccucgaacgcaaccuaaacgacacccgauacauagcgagauuccucugcggauucaucgaagaaaaccuacaucugcaaggggagggcaaaaggcgagucuucgccucaaauggacagaucacggcgcuccuacguggccucuggggccucaagaaagucagggaagaaaacgaccgacaccacgcgcuugacgccaucguggucgccuguagcacagucagcaugcaacagaaaaucacaaaggcaaugcaacgacgcgaaacccucgagacgguggauaccgaaacaggagaagucaagaccaggauaccgcagcccugggacuucuuccgccaagaagucaugaugagagucuucucagacaccccacacgaggaacucgcagaaaaacuguccggacgacccgaagcacugcacgacuucgugagcccacuauucguuagcagggcgccaaaccguaaaaugaccggacaaggacaccuagaaaccguaaaaagcgcaaaaaggcugucagagaacauaagcguaguacgaaaaccccucacggcgcuaaaacuaaaggacauagaaaauaucgucgguuaccccgacagagaaccagcacuauaccaggcguuacgcgaacgccuacaagcauacaaagacgaccccgugaaagccuuugcagagcccuucuacaaaccagccaaaaauggcggucaaggcagccuaguaaaagcgguccgcguuaaggacguccagaaaaccggggucauggucagaaaggacaggggaggaauagcccggggaaucgccgacaaugcaaccaugguccggguggacguuuucggaaagaaagguaaaaacuaccucgucccugucuacgcguggcaggucgccaaagggauccucccgaacagggccgugguagccuacgcagacgaagccgacugggacgaaauggacgacuccuaugaguucaaguucacccuauacccaaacgaccucguagaaaucauauccaagaaaggccgaaucuucggguacuacagcggccucaacagggccaccggggcaauugacauaaaggaacacgaccugucgaaagaaaaggcaaagaacggaauccaccagucuguuggcguaaagaccguacucagcuuccagaaauaucaagucgacccccuaggaaaagaaauaugccuaugcaaagucgaaaaacaccccgaacucaacagcaaaaagaagaaauga

SEQ ID NO: 7336 - RNA, 3237 nt, Artificial Sequence
  Cas9 variant
auggguuaccuaaucggacuggacaucgguauuaccucuguaggauaugccguccuucaaacagauuuuaaaggcaacccauauaagauccuacucaugaauacggucauauucccagucgccgaggccccuaagaccggcgagagcuuagccgcccccguccggcaaaaacgcagcucccgccguaccaaccgccguacaaaguuccggaaacucagaguccaaaaacuauucguccgcuucggccuucucgaaagcgccgacguagccaccuucuuaaaccaaaagguuccccaucaagauauuuggcagcuacgcaaggaugcacuaaaucggaagcuaucaaaccgcgaacuauucgaaauccucuacuucuucguaggccaucgagguuucaaauccaaccgucgcucagaagugacagguaaacagcccaaagacaaccagguuguccucacuuccauccacgacagggguaacacccucaacgacuucgacucccucggagaaaugaugcaagaacuucccgaguucaaaacuauaaaacacaacaaggccuaccgaccagacaacaccauauacccccuucgagccuggaucgagcacgaacucuccgccauuuucuccguccaacaaaagaacaaccgccaaaucacagacaacuucauaacacaauaccucgacauauuccguucgcaacgagacuucgaucaaggaccggccgccccaagccgcuucggaggcaacaugauagagcguauggucggcccagacucccucgaugcacacgaaaaacgcgccgccaaauugacaaacacguucuuucgauuuaacuuccucucgacccucaacaaccuaaaaauccaacucacccuaggcgccgaguuccacccgcugacgacaccccagcgagaaaucguuuuacaggcggcaacacucaaaucacuaaacuacaagcaaauccgacauaaacugcaacugccagacucagcccgguuuaaccuaguucccuaccagucuaacgaagacccaauaaaaaccgaaucgaaacacuaccuauuuaaacgcaaggcccucacucaaauagaagccgucaccgacaacccucaacuuaucgacaaaaucggcacaauccuggcauacuuuaaaggcgacaaaaccaggcaagaaaaacuuuccgcccucaacuuaucacgagcggaaaucaaacaacuccuucccauaaaccagcccggauucggaaaccugagccuaaagacaaugcacaaaauacucccuuaccuggagcaaggccaccucuaccacgaggccgcccaauuagccggcuaugacuuccagaacaaucucgucgaccgccaauaccuccgcgacaaccuuaaaaacccggucgucaaucgcgcgaucggcaaaacaaucaaagucgucaacgcuaucauaaagaaauacggcgauccugacgccauccacauagaacugacacgagaaaucaaacacucucacgaggaacgucagaaaauugcaaggcaaaugaacacaaacauggaccaaaacgauaaaguagcagagcaccuccgggagaacggcauaccagucaaugggcaaaacaucauaaaauccaagcucuuuuacgaacaaaaaggcaucgaccuauacuccggccaacaaauuaacgaacaagaucuauacacagaggaccauuaccaaguugaccacaucauccccuacuccaucuccuuuaacgacagcuucaccaacaaaacgguaacccgaaccaguaauaaccaaaacaaagccaaccgccuaccucuagaguaccucucugaagaaaagcaagacgcguuucgcgcucggguaaugagcaacaucuccaacuacagaaaaaggcaaaaccuccucaaggaaggcaucacagaagacaaccgccaacaguggaagacacggaauauaaacgacaccgguuacaucaaccgccugcuuucacaguaccuccgcaacaauguucaauucaccaagaaaagccacaaucccguauucaccguuaacggggccacgacagcuuacauccgcaaacguuacggcaucaucaaaaaccgccaggccaccgaccuucaucacgccgucgaugccguuaucauaggcugcaucucgaacaccuucguaagccggcucgccaaauacuccgaggcccaagaagccagauaccacaaacagcuauggcaaaucacccaauacagacaggaacacaaagaccuauccacaaucgaauaccaggagcuaaucaaacaauucccccuccccuggccagacuuccggcacgaacugauggcccgccucuccacggacccugcgaaaaugauggcacaccacacaugggaacacuacacggacgaggaaauuucgcaacuaaaacccgcauucguaauacgcuccgccaaccacaaaguaacaggcagugcccacgacgacaccaucuacuccaaaaagcuauacgaccaacgaggggucggacuucuacgaaccucacuccaaaaccucaaguacgacagcaagaaagauggcaucaaaaacuacgaacgacucaaagacggcuccaacucgcuagucuaugacucccuccuccgcgccuugaaagaacacgacggcaacgcuaagaaagcauuccccgacaaccaacuccuuauaucaacuggcaaccaucaacaaaucauaacccaugugaaaaccgucaagaaaauaacucaccccauagaggucaaucgagacacggccauagcaauaggcggccgaaugauccgggucgacaucuucaaacaagccaaagcacaaaaacucauuggcauacccgucuacguaaaugacaccgucaaaccuacacuccccaaccgugcgugcacgagcggcaaacgcuacuccgacugguaccaacuaacacgccaagaccaauuccucugcucccuaguauccaacgaccucguccuaguggaaacagccagcccgcucaaagucaccaacaauaucaccaacgaagaaguccaaacaacccaacuacucugcuacuucagcucauucaacaucgccaacgcccaaaucaacuuccacuccauaaacaacgacucaucaaucaaccccauaguccuuaacaaaguuaccuaccugaccaaauaccaacuagacuaccugggaaauuacuuucccgucaaacacgaaagcaggaaaacauuuaaccgcaaacgauga

SEQ ID NO: 7337 - RNA, 3237 nt, Artificial Sequence
  Cas9 variant
augcacacacgguuggcccucgacauaggaacaacguccauaggauggaucuuauaugaacucgugaaugggcaaccagccaguauucuagacggcggaacgcgcauauucagugacggccgugaggcaaaaacaggacacucacuagcaguaggccgacgaacagcacgagggaugagaagacggagagaccgcuaucugcgccgacgagccgcccuaaugaaacgccuagcagcaauaggacucaugccggagucaccagaagcggcggcccaacuagccacgcuggacccauacgaacuccgugcacgagggcucgaccacccacucccacccgaacaccucggcagagcacuguuucaucuaaaccagcggcgaggauucaaaagcaacagacgcacugacaaaggaaacaacgaaggaggaaugauagcagaugccuccgcaagacuagaacaagcaaugauggccgccggagcaagauccuacggagaguuccuacauaaaagacgcgcugaagccacagcccccagagcaacccccgcgguaagaacccgcaucaauccccaccuaacaggagaggacggcaaagaacagccuggguacgacuucuacccugaccgaaagcacuuggaggacgaguuccacagacuaugggaagcacaagcucgccacaacccagaccuuacacccgccaugggugaccugcucuuucaaacaauauuucaccagcgaccucucaaagcaccagccgucggucguugccucuuccuagacgaacccagacuaccuaaagcgcauccgcuaacacagcagcgcacccuauacgaaaccguuaacaugcuccgcaucgccccaccaggccaacccaaacgacggcugucacgcguacaacgcgaccaaaucguacacgcucuuaacaaccggaagaucuuagccuccccaggcaaaaacguauuaacacuugccgcaauaggaaagcuccucaaauuaagacccggagaagcauucagccuagacacagccaaccgugacgccaucgccugcgacccaguccgaaugagccucgccuacgaaggacgcuucggcccucaaugguccgcacuaucaguagaaagccagugggaacugauucaacgguuaagagacgaucaggacggcgcagcgcuagucgacuggauaauggaccgauacggcuucgauagagacagagcacgagcaauagcagacgccccucucccagaaggauucggcagacuaggggagacagcuacucgcgccguccuagccgucuuaauaggcggaacaacagaacaggagguccuuaccuauuccgaagccguggcagcaugcggaugggaccacucaaggcuaggcacgggagagguccuagacaggcuaccauacuaugggcagguacuggacagacacguccugcccggaacagggcgcccggaagacgacgaaauaacccgcuucgggcguaucaccaacccaacaguccacaucggccuaggccaagugaagcgccuagucaacaaaguaaucgacgccugggggcgaccacacgaaaugguaguagaacuagccagagaccuaaagauguccgaagaccagaaacgcaaucuagccaaaguaaacgcccagaaucaacgcgcagcagaaaugcgaagcgcuaagcuaauaggcgaccuaaagauagaagauaaugguagaaaccggggcaucuuacgcgugugggaggaguccgccgccgacguccuacaccgaugcugccccuacacaggagcacagauaagcgcauccaugcuguucgacggaucaugcgacaucgaccacaucuuaccguacagccgaacccuagacgacggauucaacaaucgcguaauuugccuaaaaagcgcaaaucgagagaaaagaaaucuaaccccaugggaagcguggggaaacacaccaaaaugggcggcaauagaagcaaaccucaaaaaccuacccccggccaaagcauggcgcuucgccccugacgcgaugcugagguaugaaggagaacgagauuucaccgcccgagcccuaguggacacccaauaccucucucgacuagcgagagaauaucuugaaugccuuuacgcggaagacauagaccccggaccacacucagggaagaaaccccguaggcccaucugggucguaaccggaaaacucaccgagcuacuacgaagacacuggggacucaacagccuccucccggacgcccaccgagguaccgccaaggccaaaaaccgucuagaccacagacaucacaugauagacgcagcagucguaggcgcaaccgaucacgccacaguacaacgaaucgcaaacauggcaaagggaaacgucgaaaacggucucgaagaccuagccggcaccauacuacccccauggcccggccuacgugacgaccuaaaagcccgacuagaacgcacaauaguaucacaucgcggaaaccacggcgcaaucgaccccgcagcccgaaagcagggacgcgauaccacaucaggccaacuccacaacgacacggcauacggacuuaccggcgaaacccucaaaggcgucccccuggucgucaaccggaagcccaucgacaugcuaacgcccgccaugauagacaaaaucagggacccacaccuauccagauggcuaaccgcuguaaccaaagggaaagaaggaaaagacuucaaagcagccgucgaggcauuccgagcacaccccggccccuauagagggaucagacgagucagacucaucgagccaguagaaguaauacgcauaaaagauagaaacggacgccccuacaaaggcuacaaaggugauaguaaccaaugcuacgagguuuggugccuccccgacagaacucucacccaccacgucgucucaacauucgccgcccaccaaggacaaaccgggaaaccccacccagccgcgaaacgccuagcaagacuauacaaaggagacaugguccgacucgaccgcagcaaguuuggauccgucaucgcgacagucgagaaauucgacagaaacggccaacuagaacucgucccucacaacgaagggaacgccgaccaacgcuaccgcaaagacaaaucagacuccguuuucaucagacuacgagcagccacauucaucgcgagcggcgcccgacgcgugauaguugacgaaaugggacgcauaagggaccccgggcccggcaagcauuga

SEQ ID NO: 7338 - RNA, 3240 nt, Artificial Sequence
  Cas9 variant
augaaguacggcaucgggcuugacugcggcaucaacagcgugggguauugcaucauggagcucaacuccgacgacgagcccaagcgcaucguccggcugaacagccgcaucuucaccgaggccgagaacccgaaggacggcuccagccuggccgcgccccggcgcgaggcccggggccuccgccggcgcauccggcgccacaagcaccggcuggagcgcauccgggcccugcucgugcgcgagaacaucgugacgcaggccgagcuggacaacauguucuccggcacgcugagcgacaucuacgagcuccggaccgccgcgcuggacgcgccccugaacaacaucgaguucgcccgcguccucaucaaccuggcucaacggcgcggcuucaaguccaaccgcaagucggagaaguccagcuccgacaaggagaccgggaagcugcucagcgccaucaagaagaacaaggaguccauugaggccggcggguaucggaccgugggcgagaugcuguucaaggaugagcgguacgccaagcacaagcgcaacaaaggggaggccuaccugaacaccgugagccgcgacaugaucgaggccgagauccacgcggucuucgccucccagcggaacuucggcaugcccuucgccaaugagaagaucgagaacgaguacaccgacaucgcccucagccaacgcccguucgaccugggccccggggagggccccgagaacugcaagagucccuaugccgggaagcagaucaagaacaugaucggccagugcaccuucuucccggaggagaagcgagcggugaaggccagcuacuccuuccagcuguucagccuccugcaaggcauaaacaacaucacccuggugagcagugacgggaacacguucccucucagccaggagcaacgaaagacccugaaggacuacugcuucaagaccgccaacgucaccuacgccuccauccggaagguacugcagaucccccaggaguacacuuucaagaacaucaccuacaccgacgacggcaucgagaaguccgagaaaaagaccaaguuccagcaccucaagcccuaccacgagaugaagaaggugcuggggagcgccauccagacgcugaccccggaggagcucgacgagaucggcgagaucuucaccuucuacaaggacgagaccaucaucaucaagcagcuugaggagacggaaaucgacaagagccuguacgaccuccugcugcaguugcccaccuucgagaaagcgggccacaucuccaccaaggccugcaagaugaucauccccuuccuggaggagggcaagaccuacgacaaagccugcgagugcgccggccugaacuucaaggcccacacgaacaugcagaagcagaugcuccugcccgccaagagcgacgagcugaacgacgucgugaacccggugguccgccgggccaucucccagaccaucaagguggugaacgccaucauccgcgagauggggacgagccccaccuacaucaacaucgaacucgcccgggagcuguccaagucgaagaaggagcgcgacgagaucaacaagaaguacaagcugaaccaggcggagaacgagcggcucaagaacgaaauaaucgacaauuucaagaucaagcccaacggccaggacaucaucaaguuaaagcuguggcacgagcaggacgacgggaucugccccuauacgggcguccgcaucaaguacgagaaccucuucgacgacggguacgccgagaucgaccacauuaucccguacucccuuagcuucgacgacuccuucaacaacaagauccugaccaccgccacccagaaccggcaaaagggcaacaggaucccccuggaguaccucccagagagcgagaaggacggcuuccgggugugggugaacuccaacauccgcaaccaccggaaacgccagaaccugcugaaggagcacuucacggaggccgacaagaaggaguucaagagccggaaccucaacgacacccgcuaccugaacaagcugcuccugaacuacaucaacgacaaccuccuguucaccgacuucuacaacgggaagaagaagcacgucaccucggugaacggcgccgugacggcguacauccgcaaacggugggggaucaauaagaaccgcgaggacggcgaccugcaccacgccgucgacgccgccgugaucgccugcgucacccagggcaucaucaaccggaucaccgcguacagcgcccgcaacgaggcccccuacgaccugaacaccgagacuggcgagaucaaggagcgguucccgcuccccuaccccaacuucaagaaggagcuggacgcccgcacgaccaucgaggacgagaagcggcugaagcgggugcucaugagcuucucaaacuacagcuacgacgacguggagaaggccaagcccugcuucgucucucggaccccgcaccgcaaggugaccggcgcggcccacgaggagaccauccggagcgggaaaguggagggcuuuaccguauccaagaccgagcugaccaaguugaagcucaccaacggggagaucgagggcuacuaugagcccgagagcgacacccugcuauacaacgcccuccugcagcgacugaacgaguucggcggggacgccaaggcggcauucgccgacgaguuccacaagcccaaggccgacggcaccccggggcccguggugaagaaggucaagaccaucaagcgguccagcuccaacgugaaggcccgcaacaagaacggccucgggguggcggacaacggcagcaugauccggaucgaugucuucuacguggagaacgagggcuacuacuucgugcccaucuacgucgccgacacggugaaggagaugcccaacgaggccugcccguucgggaaggacaagaagaagaucaugaccgacgacgacuuccuguucucccuguacccuaacgaucucaucaagaucaccgccaagaaggacaugaaauucagccuggccaacaaggaguccggccugcccaagaacaaguacgcgaacgaggugcucgucuacuacagcgccgccgacaucuccaaugccagcaucuccgugaucaugcacgacaacgccuacaaguuccgcgggugcggcaucaagucucugguuaagcuggagaaauacaccgucgacccccucgggaacgugagcaaggugaaccgggagaagcgcauguacuucaaguga

SEQ ID NO: 7339 - RNA, 3240 nt, Artificial Sequence
  Cas9 variant
augcgacuuggacucgacaucggaacaucaucaauaggaugguggcuauacgaaacugauggcgcaggguccgacgcccgcaucacaggagucguagacggcggaguacguaucuucuccgacggccgagacccaaagucaggggcaucucucgcaguagacagacgagcagcaagagcgaugcgacggagacgugaucgauaccuaagacgcagggccacgcuaaugaaaguccucgcagaaacuggccucaugcccgcagaucccgccgaagcaaaggcccuagaagcccucgacccguucgcccuaagagcagcgggacuagacgaaccccugccacucccccaccuaggcagagcauuauuccaccugaaccaaagacgaggcuucaaaucgaacagaaaaacagaccgaggcgacaacgagaguggcaagaucaaagacgcaacagcacgauuagacauggaaaugauggccaacggugcccgcacauacggcgaguuccuccacaaacgccggcaaaaggcaacagaccccagacacgugccaucaguacgaaccagacuaucaauugcaaaccgcggagggccagacggcaaagaagaggccggcuacgacuucuauccggaccgccgccaccuggaagaagaauuucacaaacugugggcagcacaaggugcucaccaccccgaacuaaccgaaacauuacgagaucuacucuucgagaaaauauucuuccaacgcccccuaaaagagcccgaagucggacucugccucuucuccgggcaucauggcgucccaccgaaagacccacgacuuccuaaagcgcacccccucacccagcgccgcguacuauacgaaacaguuaaccagcuccgggucacggcggacggccgagaggcaagaccccuaacaagagaagaacgcgaccaaguaauccacgcacuagacaacaagaaacccaccaaaagucuaucaagcaugguccuaaaacugccugcacuugcaaaaguacuaaaacuccgcgacggcgaaagguucacccuagaaaccggaguaagagacgccauagcuugcgacccucugcgggccucaccagcccaucccgaucgcuucggaccacgcuggagcauccuggacgcagacgcacagugggaaguaaucagccggauccgucgaguccaaucagacgcagagcacgccgcgcucguagauuggcugaccgaagcccacgggcucgaccgagcacacgcggaagcaaccgcccacgcccccuuacccgacggcuacggucgccuuggccucaccgcgacaacccgcauccucuaucaacuaacagcagacgucgucaccuacgcagaugcaguaaaagcaugcggcuggcaucauuccgacggaagaacuggcgagugcuucgacagacucccauacuacggagagguacuagaacgccacgucauccccggcuccuaccaucccgaugaugacgacauaacaagguucggacgaaucacgaacccaacaguccacauuggacuaaaucaacuacggcggcuagugaaccgcaucauagaaacgcacggaaaaccgcaccaaaucguuguagaacucgcaagagaucuaaagaaaucggaagaacaaaaacgagcagacauaaaaaggauccgcgauaccacagaagccgcgaagaagagaucagaaaagcuagaagaacucgagauagaagauaacggccgaaaccgcaugcuccuacgacuaugggaagaccugaacccugacgacgccaugcgacgguucugccccuacacaggcacaagaauaagugccgccaugauauucgacggcucaugcgaugucgaucacauacuacccuauucacgcacauuggacgacucauucccuaacaggacccuaugccugcgagaggcaaaucgccagaaacggaaccagacccccuggcaagccuggggcgacacgccccacuggcacgcaauagccgcaaaccucaaaaaucugccggaaaacaaacgcuggagauuugcaccggacgcaaugaccagguucgaaggagaaaacggcuuccucgacagagcccuuaaggacacccaauaucucgcgcgcauaucccgcagcuaucuagacacccuauuuacaaaaggaggacacgucugggucguacccgggcgcuucacggaaaugcuaagacgccacugggggcucaauucccuucucucagacgccggacguggcgccguaaaggcgaaaaaccgcacagaccacagacaccaugcaauugaugccgccguaauagcagcgaccgacccaggauuauuaaaccgaaucucaagagcagcaggacagggcgaagccgcgggccagucagcagaacucaucgcuagggacacgcccccacccugggagggauucagagacgaccugcgaguaaggcuugaccgaauaaucguaucacaccgcgccgaccauggcagaaucgaccacgcagcccgcaaacaaggaagagacucuaccgccggacaacugcaccaagaaaccgcauauucaauaguagacgacauccacgucgcgucacgaacggaccuccucaguuuaaaaccugcacaacuccuagacgaaccaggccgcuccggccaaguacgagacccucaauugcgcaaagcccucagagucgcaacuggcggaaagaccggcaaagacuucgaaaacgcccuuagauauuucgccagcaaacccggcccauaccaagccauaagacgcguccgcauaaucaaaccucuacaagcacaagccagagugccaguuccugcacaagacccaaucaaggcuuaccagggcggcaguaaccaucuauucgaaaucuggcgccuccccgauggcgaaauugaggcacaagucauaacaucauuugaagcccacacacuggaaggcgaaaaacgcccucaccccgccgcgaaaagacuucuucgcgugcacaaaggcgacaugguagcacuagaacgagaugggcgaagaguaguaggccacguacagaaaauggacauagcaaacggccuguuuauagucccucacaacgaagcaaacgccgacacgcgcaauaacgacaaaucagacccauucaaauggauccaaauaggcgcgcguccagccauagccucgggaauacgacgcgucucagucgacgaaaucggccgacuacgcgacgggggcacccgccccauauga

SEQ ID NO: 7340 - RNA, 3240 nt, Artificial Sequence
  Cas9 variant
auggacgaggaggccaaaauccagcugagcaaggaguccuacgaggaggagcucgagagccugcuggagaaguccggcgaggaguuucgcgacguguuccuccaggccaagaaggucuacgacgcgauccugcugagcgacauccucuccaccaagaagcagaacagcaaggcgaagcugucccugggaaugaucgagcgguacgacagccacaagaaagaccucgaggagcugaagcaauucgugaaggccaaccugcccgagaagaccgccaucuucuucaaggacuccucuaagaacggcuacgccggguacaucgauggcaagacgacccaggaggacuucuacaaguuccucaaaaaggagcugaacgggauagcgggcuccgagcguuucauggagaagguggaccaagagaacuucuuacucaagcagcggaccaccgccaacggcgucaucccgcaccaggugcaccugacggagcugaaggcgauaaucgagcgccagaagcccuacuaccccuuccucgaggaggcccgggacaagaugauccgccugcugaccuuccggauccccuacuacguggggccgcucgcgcagggcgaggagaccagcuccuucgccuggcucgagcgcaagacccccgagaaggucacccccuggaacgccaccgaggugaucgauuacagcgccuccgccaugaaguucauccagcggaugaucaacuacgacaccuaccugcccaccgagaaggugcucccgaagcacagcauccuguaccagaaguacacgaucuucaaugagcugaccaaggucgcuuacaaggacgagcgcgggaucaagcaccaguucuccagcaaggagaagcgggagaucuucaaggagcuguuccagaagcagcgcaaggugaccgugaagaagcugcaacaguuccugucggccaacuacaacaucgaggacgcugagauccucggagucgacaaagccuucaacagcagcuacgccaccuaccacgacuuccuugaccuggcgaagcccaacacggagcggguggccgaauuacuggagcagcccgagaugaacgccauguucgaggacaucgugaagauccugaccaucuucgaggacagagagaugauuaggacccagcucaaaaaguaccaguccguccugggggacggcuucuucaagaagcuggugaagaagcacuacaccggcuggggucgccucagcgagcggcugaucaacggcauccgcgacaagaagacgaacaagaccaucuuagacuaccucaucgacgacgacgacuuccccuacaaccggaaccgcaacuucaugcagcugaucaacgacgacucccugagcuucaaggaggagcucgccaacgagcuggcccucgcggggaaccagucucuccuggagguggucgaggcucugcccggcagcccagccaucaagaagggcaucuggcagacgcugaagaucguggaggagcucaucgagaucauuggguacaaccccaagaacaucguggucgagauggccagagagaaccagcgcaccaaccgcuccaagccccggcugaaggcccuggaggaggcgcucaagagcuucgacuccccgcugcugaaggagcagcccguggacaaccaggcccuccagaaggaccgccuguaccuguacuaccuccagaacggcaaggacauguacacgggggaggcccuggacaucgaccggcugagcgaguacgacaucgaccacaucaucccccgcuccuucaucguggacaacagcaucgacaauaagguccucguguccagcaaggagaaccggcugaagauggacgacguccccgaccagaagguggugauccgcaugcggcgcuacugggagaagcugcucagagccaaccugaucuccgagcgcaaguucgcguaccugaccaagcucgagcugaccccggaggacaaggcccgguucauccagcgccagcuggucgagacccggcagauaacgaagcacguggccgccauccucgaccaguacuucaaccagcccgaggagagcaagaacaagggcauccgcaucaucacccugaaauccagccuaguaucccaguuccggaagaccuucgggauccacaaggucagggagaucaacaaccaccaccacgcccacgacgcguaccucaacggcgugguggccaucgcccugcugaagaaguaccccaagcucgagcccgaguucgucuacggcaacuacaccaaguucaaccuggccacggagaacaaggccaccgcgaagaaggaguucuacagcaacauccugcgguucuucgagaaagaggaguacagcuacgacgagaacggggagaucuucugggacaaggcccgccacaucccgcagaucaagaaggugaucuccagccaccaggugaacauugucaagaagguggaggugcagaccggcggguucuacaaggagaccgucaaccccaagggcaagcccgacaagcucauccagcggaaggccgguugggacguguccaaguacggcggcuucgggagccccgucgucgccuacgccguggcguucaucuaugagaagggcaaggcccgcaagaaggccaaggccauugaggggauaacgaucaugaagcagucccuguucgagcaggacccgaucggcuuccugagcaacaagggguacuccaacgugaccaaguucaucaagcucagcaaguacacccuguacgagcuggagaacggccgccggagaauggucgcgucccacaaggaggcucagaaggccaacagcuucauccuccccgagaagcuggugacccuccucuucuacgcccagcacuaugaugagaucgcccacaaggaguccuucgacuacgugaacgaccaccugagcgaguuccgggagauccuggaccaggucaucgacuucuccaaccgcuacaccaucgcggccaagaacacggagaagaucgccgagcuguucgagcagaaccaggagagcaccgugcagucccucagccaguccuucaucaaccugaugcagcucaacgccaugggcgcccccgcggacuucaaguucuucgacgugaucaucccgcggaagcgauaccccagccugaccgagaucugggagagcaccaucauauaccaguccaucacggggcugcgggagacacgcacccggauggccacccucugggacggcgagcaguga

SEQ ID NO: 7341 - RNA, 3240 nt, Artificial Sequence
  Cas9 variant
auggacgaggaggccaagauccagcugagcaaggaguccuacgaggaggagcuagagagccugcuggagaaguccggcgaggaguuccgcgacguguucuugcaagccaagaaggucuacgacgcgauccugcugagcgacauccucuccaccaagaagcagaacagcaaggccaagcugucccuggguaugaucgagcgguaugacagccauaagaaggaccucgaggagcugaagcaguucgugaaagccaaccugcccgagaagaccgcuaucuucuucaaggacuccagcaagaacggcuacgccggguacaucgacgguaagacgacccaggaggacuucuacaaguuccucaagaaggaguuaaacgggaucgcgggcuccgagcgcuucauggaaaagguggaccaggagaacuuccugcucaagcaacggaccaccgccaacggcguaaucccgcaccaggugcaccugacggagcucaaggccaucaucgagcgucagaagcccuacuaccccagccucgaggaggcccgagacaagaugauccgccugcugaccuuccggauccccuacuacguggguccgcucgcgcagggcgaggaaaccuccagcuucgccugguuagaacgcaagacucccgagaaggucacgcccuggaacgccaccgagguaaucgacuacuccgccagcgccaugaaguucauccagcggaugaucaacuacgacaccuaccugcccaccgagaagguucucccgaagcacuccauccuguaccagaaguacacaaucuucaacgagcugaccaaggucgcguacaaagacgagcgcgggaucaagcaccaguucagcuccaaggagaagcgggagaucuuuaaggagcuauuccagaagcagcgcaaggugaccgugaagaagcugcagcaguuccugagcgccaacuacaacaucgaggacgccgagauccucggcgucgacaaggccuuuaacagcuccuacgcaaccuaccaugacuuccuggaccuggcgaagcccaacacggagcggguggccgaacuccuggagcagcccgagaugaacgccauguucgaggacaucgugaagauccugaccaucuucgaagaccgcgagaugauccggacccagcucaagaaguaccagagcguccugggggacggcuucuucaagaagcuggugaaaaagcauuacaccggcugggggcgccucagcgagcgacugauaaacggcauccgcgacaagaagacgaacaagacuauccuggacuaccucauugacgaugacgacuuccccuacaaccggaaccgcaacuucaugcagcuuauaaacgaugacagccugaguuucaaagaggagcucgcuaacgagcuggcccuggcggggaaccaaagccuccuggagguggucgaggcccugcugggcuccccggccaucaagaaggggaucuggcagacccucaagauuguggaggagcugaucgagauuaucggguacaaccccaagaacauuguagucgagauggcccgggagaaccagcgcaccaaccgcagcaagccccggcugaaggcccucgaagaggcgcugaaguccuucgacagcccccugcucaaagagcagccgguggacaaccaggcccugcagaaggaccgccuguaccucuacuauuugcagaacggcaaggacauguacacgggggaggcccuggacaucgaccggcucuccgaguacgacaucgaucacauuaucccccgcagcuucaucguggauaacuccaucgacaacaagguccuggugagcuccaaggagaaccggcugaagauggacgacguccccgaccagaagguagugauccgcaugcggcgcuacugggagaagcuccugcgggccaaccugaucagcgagcgcaaguucgccuaccucacaaagcuggaguuaacccccgaggacaaggcccgguucauccagcgccagcucgucgagacccggcaaauuacgaagcacguggccgccauccuggaucaguacuucaaccagccggaggaguccaagaauaagggcauccgcauuaucacccucaagagcucccucgugagccaguuccggaagaccuucgggauuaacaagguccgcgagaucaacaaccaucaccaugcccacgacgcguaccugaacggggugguggccaucgcccugcucaagaaguaccccaagcuggagcccgaguucguauacggcaacuacaccaaguucaacuuggccacggaaaacaaggccaccgcgaagaaggaguucuacagcaacaucuuacgguuuuucgagaaggaggaauacucauacgacgagaauggggagauuuucugggacaaggcccgccacaucccccagaucaagaaggugaucagcucccaucaggugaacaucgucaagaaaguggaggugcagacaggcgguuuuuacaaggagaccgucaacccgaagggcaagccggacaagcugauccagcggaaggccgggugggacgugagcaaguacggcggcuucgggucccccgugguugccuacgccguggcguucaucuaugagaagggcaaggcgcgcaagaaggccaaggccaucgagggcaucacgaucaugaagcagagccuguucgaacaagaccccaucggcuuucucuccaacaagggcuacagcaacgugaccaaguucaucaagcuguccaaguacacccuguacgagcucgagaacggccgccggcgcauggucgccagccacaaggaggcccagaaggcgaacucuuucauccuuccugagaagcugguuacccuccuguaccaugcccagcacuacgacgagaucgcccauaaggagagcuucgacuacgugaacgaccaccuguccgaguuucgggagauccucgaccaggucaucgacuucagcaaccgcuacaccaucgcggccaagaacacggagaaaaucgccgagcuguucgagcagaaccaggaguccaccgugcagagcuuaucccaaucauucaucaaccucaugcaguuaaacgccaugggcgcccccgcggacuucaaguucuucgacgugaucaucccccggaagcgcuacccgagccugaccgagaucugggaguccaccaucaucuaccagagcaucacagggcuccgggagacccgcacgcggauggccacccugugggacggagagcaguga

SEQ ID NO: 7342 - RNA, 3243 nt, Artificial Sequence
  Cas9 variant
augaaaacgucguucgcauucgacauaggaacaaacucuauaggguggugcguacuagcacuggauaacgcgaaccuaccauaccgaauacuagaugcuggagucagaauauuuagcgauggacgcgaaccaaaauccggcacaagccucgcggaaggcagacgacuagcucgaggaaugagcaggcguagagacagguacaaacgcagacggaaggcugucauccgaacacuuauagaauacggccugaugcccgacgaccccgcagcgcggagagcacucguggcagagacuaaugacaaagcacccgggaagaucgcgagcgacguguacgcacuaagggcccgagcacucgacgauaaacugccccuacaccacauaggucgcgcccucuuucacaucaaccaaaggagaggcuucaaaagcaaccgcaagacagacaagcgagacaacgaccagggcaaaauagcuucaggaauaucccggcuccgcgacaaacuagccagcgaaggcaugagaacgcugggggaauaccucaaccacaggcaccaagcgggaaacuggguccgaguaagaccaagccgaguacccgggaaagacgauaaagaagaagacggcuacggauucuaucccgagcgagcacuccuacaggacgaauuuaacgcgaucuggacagcacaggccgcccacuacccagacguccucaccgaagaacgccguacccaccuagaaaccaucaucuucuuccagcgaccacucaaacccguacaagucgguaagugcucguucaaccccggggaagaacggcuaccccgcgcccauccacuauuccaagaguuccgcuuauacaaagaaguaaacgaacuggagcuagucgacagaaaucaagaccaccacaaacugagucucgaccagcgagacgcacucauagcacagcuaaagacgcagagagaagccgcauacucagcgcucagaaaaacagcgagagcgccauuaggcacgcgguucaacaaggagacagaaagccgaacaaagaugaaaggagaugaagucgcagcggaacugagcgccaaaacaagguucggacaagcauggauaaguaugccacucgaggaacgcuggaucauaguagacacccuaagaagggucgaggacccccuggaacuaacugcauggcuagaacaacauuacgggcuagacggagaacauauagacgcgauccuagcagcaagacuaccagaaggguacggacgccucggagaaacggcacuaacagagauacuggucgaacuuaaggccgccguaauauccgaagccgaagcagcgagacgggccggguacgaccaugcccugcuccaaaggggcgccggucuggaggcccucccaaaguaccaagaaguaauugcaaggcgcauucccccgggaaccggcaaucccgacgaccccuacgacgucgaaaaaggcagaauaacaaaccccacgguccacauagggcuaaaccaacuucagaaagucuuaaacgcccuaauucgccgauacgguaagcccgaacagaucgccauagaacucgcacgggaacucaaauuaaacgacgagcaaaaacgcgagaaaaacaucgaaauugcacgcaacacacgcgccgcagaacaaagaucagccaaguuaguagagcugggcguacccgacacaggcuacaaccgcguacuccuuaaacuaugggaggaacuaaaccugcgcgcacccgaaaacagaguaugcauauacugcggagaaccuaucaacauagaaacccuuuucucaagcgcaguagacaucgaccacauacugccauggucaaagacacucgaugacucacaagcaaaccgucuaguaugccacguggcaugcaacagacaaaaagcuaacuacgcaccagccgaagucccacaauggcaaggacgauacgacgauauccuggcacgggcaaauacacucccccucaauaagcgauggagauucgggagagacgcgaugaaaaaguucgcagacgaagagaccuuccucgcgagacaacuaacagacacacaauaccuauccagacuagcacacgcauacauggcggcccuauacccagacgaagaaccggacgcgcaagggguccucgcacggaaaaaccacguacgcguaauaaccgggcggaugacggaaaugcuaagacgccaauggggacugaacagccuccucgcggaccacaaccagaaaaacagaaacgaccaccgacaccacgccaucgacgccgcgguagugggcgugacaacacgcgcccuucuucaacgaaucgcaaccgucgcugggggccgagaggcccaagcgcuggaagaaacaauugggaaaauagaaccaccauggcccgguuuccgcgacgaacuccaagcagucauaaaacgaauaguaguuagccacaaaccggaccacggcacacuaccaaaacccggccaaggcggccaaacggcaggacaacuacauaacgacacggcauacggacucacaggcgaaacagacucaagaggcacuccaaucguggucagacgcaaacccuucacaagccuaacagagaaagaccugcccucaauacgcgaccgccaacuagcgcaggcccuaggaucagccauagcaggucgaaguggaaaggaacugcaagcagcucuggagcaguuccgcgacagagacgacuacaagagcauccgccacguaagagucguggagccacugaacgucauccccauacgagacggcacggggcgcgccuacaaagcauauaaaggggacgcaaacuaccgauacgacgucugggaacucccgaacggcaaauggaugcaugaggucgugagcauguucgaugcccacgacagaucauggaccuccgcuguccacauccaccaccccgccgcgcgcagaguacucucgcuaaaacaaaacgacauggucgccuacgaccacccacaagacggaccgacaauaggaaggguagugaaauucagccaaagcggacagaugacauucgccccacauaaagaagcaggcgcacuaaaagcacgugacgcagaccccgaagaccgcuucagguacuucuacaaauccggaagcgccaugaaagauaucggccuccgccaaguacgcgucgacgagaucggacgcguuuucgaccccgggccacgcgacaaagaagcaaggaacgcacgcaaaaagaaaagcacagauuga

SEQ ID NO: 7343 - RNA, 3243 nt, Artificial Sequence
  Cas9 variant
auggcaaagagcuucgcauucgacaugggcacgaacucaauaggaugggcaguccugggacuagacagcgcaggcgaccccgacucgauugagggagcaggaguaagaauauucagcgacggacgagaacccaaaagcggagccucacuggcagaagggagaagaauagcccgugggaugagccgcagaagagaacgauacaaagcgcggcgcaaagcgcucauacgcacccucggcgacuacggacucaugccauuagaaagggcagccaggagggcgcuaguagcugaaacaaacgacagaucauucggauuggucgcacaggacgucuaugcccuaagagcccgcgccuuaguagaaaagcucccaccauaccaccugggcagagcccucuuccaccuaaaccaacgaagaggauucaaauccaaccgcaaaacagacggacgcgacaacgaacugggcaugaucgcaacagguaucgcagcccuggacgcucaacuaaacggaagaacccuagggcaauacuuacacgaaaugagaggagcggacccgagacaaaggggacaagugcgaguacgaccacaccucgaaaucaacgacaaaggaagggaaaucgccgcauacggauucuacccucagagagcaauguuagagcgagaguucaacgccaucugggccgcacaagcaccccaccacccagaacugcucucggaagaaagacgagcccacuuauuccagguaauauucuaucaaagaccgcuaaagcaacccgaccccggccgaugcucauucaacccagcagaaccgcgacucgcuaaagcccacccacuuuuccagagauuccgacuggucaaggaaaucaacgaacuacgcaucgucaccggcagcaauagccaaggcgugccccucacacuagaacaacgcgauauccuccucacgcugcuacgagauaagaaagcauccaguuucaaaacgcuacuggcaaaaaucauaaaaggccagccugaagcucgcuucaacaaagccucggacucaagagacaagaugaagggggacgaacuggcggcaacaauguccgacaaaacccgguucggccaagcaugguucgccaugcccgaagcugaacaauggcgcaucauagcgaaacuacgugacauugacgacccacucgaacuaaacgccuggcucgaaucagaauacggccucgcgcccgaaagaagagacgcuguugccaacgcacuacuuccacagggauacggccgacuuggagaaacggcacuacgcacgaugcuagacuacuuagaggcagcugugauaagcgaagcagaagccgccgcccaggccggauacgaccacgcacucgcgcgcagaggcgcgggccucgaccaacuacccaaauaccaagaaguguugggcaggcguaucccaccaggcucaggugaaccaaacgacccauacgauauccgaaugggacgaauauccaauccaaccguccauaucgcccuaaaucaauugcgaagagucguaaaugcgcucauacguaaauacgggaaacccgccgaaaucgcaaucgagcuagcccgagaccuaaaacucuccgaagaacaaaaacgggagguaaacgcaaccauagccaaaaacacccgagacgcagaaagacgagcuguaagacucgcagacgaaggcauagacaacacaggacacaaccgagcgcuacuacgauucugggaagaguuagcagccgacccgcuagaucgagugugcguauauugcggcggaggaauaggcgcagccucacuauucaacggaagcgucgacaucgaccacauccugccauggaguaggacgcucgacgacagcagagccaacagaauacucguacacaacucauguaauagacuuaaaaggaauuucgcgcccuucgaaguacccgaauggagagaaauauaccaagacauacuuguacgagcggccaaacucccggcaaauaaaucauggcgguucgcgcccgacgccauggaccgauucgagggcgaaaaagacuuccuagcccgacaacucaccgacacccaauaucucgcacguauggcccacgaauaccuagcugcccuuuaccccgacgaagaaccagacgaauggggagucuucgcucgaggaaaccauguaagaguagucccaggacgacuaacagaaauguuacgacgagccuggggccuaaacgccauccuauccgaugacaacaggaaaaacagaaacgaccacagacaccacgcuauagacgcggucgucguaggugucacaaccagagacaugcucaauaaaauaucucaagcagcgggcaggggcgcagacaugggagccgccgacgcacuccgaagauucgacccuccauggcccagcuuccaccaagccguacgagccgccguagaacgcauccuagucucccaccgcgcagaccacggaacgcugcccgguacggacggacaaggcucgacagcaggacagcuccauaacgacaccgccuacggccugacuggggagacacguaaaggacuagcugucgucguacgaaggaaaccauaccucucccuagagccaagagauauagaaacaaucagagacccgcaacugcgagaccaccuagcuacagaaacguacggacuagcaggcgccgaguucaccgcagcccuaaaaaggcuccagcaaacagacaaguucuacgcaggaaucagacgcgugcgaguaaccgaagcacugagcgucaucccaaucagggacgccacaggacacgcauacaaagccuacaagggggacgcuaauuucagauacgacguaugggaacuccccaacgguaaauggguacccgaaguaaucagcauguucgaugcgcacgaccguggcugggucucacagguccacgcagcaaacccagccgcacgaagaguauuaagccuaaggcaaaacgacaugguagcauaccaacacccugaacaaggacuuguguacggacgcguagucaaauucgggcaaucgggccagaugacauucgccgcccaccacgagggaggaagccucaaaucacgagaugcagaccgcgaugacccauucaaguacuucuacaaaagcgcgggcacgaugaaagacaucggccuacgccaaauaagaguagacgaaaucggcagagugcaagacccuggcccacaagaucgcgauagcaaacgcguacgaaaaagcgaccguuga

SEQ ID NO: 7344 - RNA, 3246 nt, Artificial Sequence
  Cas9 variant
auggccgccuucaaaccaaacccaauaaacuacauacucggucucgacaucggaaucgccagcguaggaugggccaugguagaaaucgacgaagacgaaaacccuaucugccugauagaucucggaguucgcgucuucgaaagagccgagguacccaaaacgggagacagccuggccauggcuagacgucuggcaaggagcguacggcgacucaccagacgacgcgcccaccgccuccugcgagcgcgacgccuacugaaaagagaagggguucuccaagcggccgauuucgaugaaaacggccuaaucaaaagccugcccaacacaccauggcaacucagggcagccgcacucgaucgcaaacuaacgccccuagaaugguccgcaguacuccugcaccugauaaaacacaggggcuaccuaagccaacgcaaaaacgaaggagaaaccgcugauaaagaacuaggagcccuccugaaaggcguagcugauaacgcgcacgcccugcaaaccggugacuuccgcacgcccgcaaaacuggcauuaaacaaauucgaaaaagaaagcggccauauacgcaaccaacgcggcgacuacucacacacuuucagccgaaaagacuugcaagcggaacucaaccuacucuucgaaaaacagaaagaguucggcaacccccacaucucagacggacuaaaagaaggcaucgaaacacuacugaugacgcaacgaccggcucucagcggcgacgcaguccagaaaaugcuaggacacugcacuuucgaacccacagaaccaaaagcagccaaaaacacauacacagcagaaagguucguguggcugacuaagcucaacaaccucagaauccuagaacaaggauccgaacaaccccuaaccgacacccaacgagcaaaacucauggacgaacccuacagaaaaagcaaacucaccuacgcccaagcaagaaagcuccucggacucgaagacacagcauucuucaaagggcuaagguacggaaaggacaacgcggaagcaagcacacucauggaaaugaaagcauaccacgccauaucgcgcgcgcuagaaaaggaaggccucaaagauaagaaaagcccccucaaccuaucgccagagcuccaggacgaaauaggaaccgccuucucccuauucaaaacagacgaagacaucacaggacgccucaaggaccgcguccaacccgaaauacuugaagcccuccugaaacauauuagcuucgacaaauucguacaaauaucacuaaaggcacuaagacgaaucgugccacugauggaacagggcaagcgcuacaacgaagcaugcgcagaaaucuacggagaccacuacggaaagaaaaacaccgaagagaaaauauaccuaccacccauacccgcggacgaaauacgaaacccaguaguacugcgcgcccuaagccaggcacgcaaagucauaaacggaguggugagacgcuacggauccccagcacggauccacauugaaacggcccgggaaguaggaaagagcuucaaggaccgaaaagaaauagagaaacgccaggaagaaaaccgcaaagauagagaaaaagccgccgcaaaauuccaagaauauuucccaaacuucgucggcgaaccaaagagcaaagacauacuuaaacuacgacuauaugaacaacagcacggaaagugccucuacaguggaaaagaaauaaaccugggacgacugaacgaaaaaggcuacguagaaaucgaccaugcccucccguucagcagaacuugggacgacucauucaacaacaaggugcuaguacugggaagcgaaaaccagaacaagggcaaccaaacgcccuacgaguauuucaacggcaaagacaacucccgugaguggcaagaguucaaagcccgcguagaaaccagcagauucccgagaucaaagaaacagcgaauacuacugcaaaaauucgacgaagacggauucaaagagaggaaccuaaacgacacacgauacguaaaccguuuccuaugccaauuugucgcagaccgcaugagacuuaccggcaaaggcaagaaacgaguauucgcguccaacggacaaaucacaaaccuccuccguggguucuggggucugcgaaagguacgagcggaaaacgacagacaccacgcccuugacgcaguaguagucgcgugcuccaccguagccaugcaacagaaaaucacaagauucguccgcuauaaagagaugaacgccuucgacggcaaaacaauugauaaggagaccggcgagguacuccaucagaaaacccacuucccccaaccaugggaguucuucgcccaagaagucaugaucaggguauucggcaaaccagauggcaaacccgaguucgaagaagcggacacacccgaaaagcuccgcacccuucuugcggaaaaacuaucaucccgacccgaggcgguccacgaguacguuacaccacuauucguaagcagagccccaaaccgaaagauguccggccaaggacacauggaaacggucaaaagcgccaagcgccuugacgaaggggucucaguccucagaguaccguuaacccagcucaagcucaaggaccucgaaaagauggucaaccgagagcgcgaaccuaaacuauacgaagcucuaaaagcacgccuagaagcccauaaagaugacccagcaaaagcauucgcagaaccuuucuacaaguacgacaaggccggaaaccgaacgcaacaaguaaaagcuguuagagucgaacaaguacagaaaacaggcguguggguacgcaaccacaacggcaucgcagacaacgcaacaaugguacgcgucgacguauucgaaaagggagacaaauacuaccucgugccaauuuacuccuggcaagucgccaaaggcaucuuacccgaucgcgcgguuguagcauacgcagacgaagaagauuggaccgucauagacgaaucguucagguucaaauuuguccucuauagcaacgaccucauaaaaguacaacucaagaaagacagcuuccuaggauacuucagcggacuggaccgagccacaggagcaauaagccuucgcgagcacgaccuagaaaaaucgaagggcaaagacgggaugcacaggaucggcguaaaaacagcacucuccuuccaaaaauaccaaauagacgaaauggggaaggagauccgaccaugccgccugaagaaaagaccgcccguccgauga

SEQ ID NO: 7345 - RNA, 3246 nt, Artificial Sequence
  Cas9 variant
auggccgcauuuaaaccaaacccaaucaacuacauacucggccuggacauagggauagcgagcgugggcugggcaauggucgaaauagacgaagacgaaaaccccaucugcuuaaucgaccuaggaguccgcguuuucgaaagagccgaagugcccaaaacaggagacucucucgccgccgcccgccgacuggcccggagcgucagacggcucacaagaagacgagcccaccgcuuacuacgcgcaagaaggcuacucaaaagagaaggaguccugcaagcagccgacuucgacgaaaacggacuuaucaaaucacugcccaacacgcccuggcagcuacggagcgcggcccuagaccggaaauuaacgccacuagaauggucagcgguacuccuccaccucauaaagcaccgaggauaccucucacagcggaagaacgaaggcgaaaccgccgacaaagaacuaggagcccuccuaaagggcguggcagacaacgcgcacgcacuacaaacaggggacuuccggacaccggcagaacucgcucucaacaaauucgagaaggaaucggggcacauacguaacaggcgaggcgacuacucacacacuuucucaagaaaagaccuccaagcugaacuagaccuacucuucgaaaagcaaaaggaguucggcaacccacacauaucggacgaccuuaaagaggguaucgaaacacuccugaugacccaaagaccggcccuaagcggagacgccgugcagaagaugcuaggccauuguacauucgagccgacggagcccaaggccgccaaaaacaccuacaccgcggaacgguucguauggcucacaaaacuaaacaaucuccgaauccucgagcaaggguccgaaagaccccugaccgacaccgaacgagccacgcucauggacgagccuuaucgaaaaagcaaacuaaccuacgcacaagcccgcaagcuauuagaacuagacgacacagccuucuucaaaggacuacgauacggaaaggacaacgcagaagccaguacgcuaauggaaaugaaagcauaccacgccauaaguagggcacucgaaaaggaagggcucaaggacaagaaaagcccauuaaaccucagcccagaacuacaagacgaaauaggcacagccuucagccuguucaaaacagacgaggauauaacaggcagacucaaggaccgaguccaaccagaaauacucgagguccuacuuaaacacaucucguucgacaaguucguacaaauaucccuaaaggcccuacguaggaucgucccgcucauggaacagggaaaaagauacgaugaagcaugcgcggaaaucuacggcgaccacgacgggaagaaaaacacggaagagaaaaucuaccucccacccaucccugcugacgaaauccgcaacccaguggugcuacgcgcgcuaucacaggcgcgcaaagucauaaacgcagucguccgccguuacggaagucccgcccgaauacacaucgaaacagccagagaggucggaaagagcuucaaagauaggaaagagaucgagaaaaggcaggaagaaaaccgaaaagacagagaaaaagcagccgccaaauucagagaauacuucccaaacuucgugggggaacccaagagcaaggauauccuaaaacuacgacuguacgagcaacagcacggaaaaugucuguacuccggaaaagaaauaaaccucggccgacuaaacgaaaaaggauacgucgaaauagaccacgcgcugccauucagccguaccugggacgacagcuucaacaauaagguccuaguacuaggaagugagaaccaaaauaagggcaaccaaacccccuacgaguacuucaacggcaaagacaacagccgggaauggcaagaguucaaagcacgcguagaaacaagccgauucccuagaagcaagaaacaacgcauacuccuacaaaaauucgaugaagagggauucaaagaacgaaaccuaaacgacacgagguacguaaaccgcuuccugugccaguucguagcggaccacaugcugcuaaccggaaaaggcaaacgccgcgucuucgcaaguaacggacaaaucaccaaccuacuccggggauucuggggccuccggaaaguccgagccgaaaacaaccggcaccacgcccuagacgcggucgugguagccugcagcaccguugcuaugcaacaaaagaucacaagauucguaagguacaaagaaaugaacgccuucgacggcaaaaccaucgacaaagagaccggcgagguacuccaccagaaaacgcacuucccccaaccaugggaguucuucgcgcaagaagugaugauaagaguauuuggcaaacccgacgguaagcccgaguucgaagaagcggacacgcccgaaaaacuucgaacccuacuagcagaaaaacuuagcucccgaccugaagcaguccacgaauacguaaccccacucuucguaucaagagcacccaaccgaaaaaugucgggacaaggccacauggaaaccgucaaaagcgcaaaaagacucgacgaagggguauccguccuucgcgucccacucacacaacucaaacuaaaagaccuagagaagauggugaacagagaaagagaaccgaaacucuacgaggcgcuaaaggcaaggcucgaagcacacaaggacgaccccgccaaagccuucgcggagccguucuacaaauacgacaaagcggguaaccgaacccaacagguaaaagccguccgcguagagcagguccagaaaaccggggucugggugcggaaccauaaugguauagcggacaacgccacuaugguccgcgucgacgucuucgaaaaagcuggaaaguacuaccuagugccaauauacagcuggcaaguagcaaagggaauacugccggaccgggcagucgucgccuacgcggacgaagaaggauggaccgucauagacgaaucauuccgauucaaauuuguccuuuacaguaacgaccuaauaaaaguccaacuaaagaaagauagcuuccuagguuacuucagcgggcuugaccgagccacaggcgccaucagcuugcgagaacacgaccuagagaaaagcaaaggaaaagacggcaugcauagaauaggagugaaaacagcacuauccuuccaaaaguaccaaauagacgaaaugggcaaagaaauaaggcuauguagacugaaaaagcggcccccagugcgcuga

SEQ ID NO: 7346 - RNA, 3246 nt, Artificial Sequence
  Cas9 variant
augaccgccuucaaacccaaccccaucaacuacauucucggacucgacaucggcaucgccuccguuggcugggccaugguagaaaucgacgaggaggaaaacccgaucagacucaucgaccucggcgucagggucuucgaaagagcugaagugccgaagaccggcgacagccuagcggcugcccgucgacucgcccgaagcguucgaagacuaacccgcagacgagcccacagacuacugagagcaaggcgucuacugaaaagggaaggcguccugcaagcagcggacuucgacgaaaauggccucauaaaaucccuaccaaacacccccuggcaacuucgagcugcagcucuggacagaaaacucacaccccuggaaugguccgccguacuacugcaucugauaaaacaccgcggguaccucucgcagcggaaaaacgagggggaaaccgcagacaaagaacugggcgcacuacuaaagggaguagcggauaacgcccacgcccuccagaccggagacuuccgaaccccagccgagcucgccguuaacaaauucgaaaaggaaagcggccacauccgcaaccagagaggggacuacagccacaccuucucaaggaaagacuuacaagcugagcuuguccuccuauucgaaaaacaaaaagaguucgguaacccccacaucagugacggacucaaagaaggaauugagacacuccucauggcccaacgaccugcacucuccggagacgccguccagaaaaugcuaggauacugcacauucgaacccaccgaacccaaagcggcgaagaacaccuacacagcggagcgauucaucuggcucacgaaacugaacaaccuaaggauacuagaacaaggaagcgaacgcccgcuaacggacaccgagcgcgccacccucauagacaugcccuacaaaaauaaacucaccuaugcgaaagcccgagaacuacucggacucgacgacaccgcauucuucaagggccucagguacggaaaggauaacgcagaaagcgcaaccuuaauggagaugaaggcuuaccacgccauacgcagagcccuagaaaaagaaggccuaaaggacaagaaaagcccguuaucacucucgccagaacuccaagacgaaaucggcaccgcguuuagccuauucaagacagacgaagacaucacaggccgccucaaaggaugccugcaaccagaaauccucgacgcccuucugaaacacaucaauuucgacaaauucguccaaaucagcuugaaggcacugcgaagaaucguaccacucauggaacaaggaaaacgauacgacgaagccugcgccgagaccuauggagaccacuacggcgagaaaaacucagaagaaaugcuguaccuaccaccgaucccagcggacgaaauccgcaacccagugguccugcgggcgcugucacaagcacgaaaagucauuaacggaguaguccgcagguauggcucacccgcccgaauacacaucgaaacagcucgagaaguaggaaagagcuucaaagaccgcaaagaaauagagaaacgccaagaagagaaucgaaaggacagggaaaaggccgcugccaaauuccgcgaauacuucccgaacuucgucggagaacccaaaagcaaagacauccugaagcugcgccuauaugaacaacaacacgggaaaugucucuacagcggaaaagcgaucgacaucagacgacucaacggcaaaggauacgucgagauugaucacgcacuaccauucagccgaaccugggacgacuccuucaacaacaaaguccucguauuaggaucagaaaaccaaaacaaggguaacagaacaccauacgaauaccuaaacggcaaagacaacagccgagaguggcuugaguucaaagcaagaguggaaacaagccgcuucccccauaguaagaaacaaagagugcuccuacaaaaauucgacgagaaaggcuucaaagagcgcaaccuaaacgauacgagauacgucaaccgguucuugugucaauucguagccgaccacaugcaacugaccgggaaaggcaaacggagaguauucgcuuccaacggucaaauaacuaaccuccugagaggcuucuggggauuacacaaaguaagggcagaaaacgaccgacaccacgcgcuagacgcggucgugguagcaugcuccaccgucgcaaugcaacagaaaauaacauguuucgucagguacaaagaaaugaaugcauucgacggcaagacaguagacaaagaaaccggagaaguucuucaccaaaagacccacuucccacaacccugggaguucuuugcucaagaaguaaugauccguguuuuugguaaaccagacggcaaacccgaguucgaagaggcagacacccccgagaaacuaagggcacugcuggcugaaaaacuuuccucccgccccgaggcaguccacgaauacgucacaccacuauucgucucacgagccccgaauagaaaaauguccggcgcacacaaagauacacuccgcucggcaaagcgcuucguaaaacacaacgagaaaauaagcguaaagcgcgucuggcuaacugagauuaagcuggcugaccuagagaacauggucaacuacaagaacggccgggagaucgaacucuacgaggcacuaaaagcgagauuaggcgccuacggaggcaacgccaaacaggcuuucgacccaaaagacaaccccuucuacaagaaaggaggacaacucguaaaagccguaagagucgagaaaacccaagaauccggcguccucuugaacaagaaaaacgcguacaccaucgccgacaacggagacaugguacgcguagacguauucugcaaaguagacaagaaaggcaaaaaccaguacuucauuguacccaucuaugccuggcaagucgcggaaaacauccuccccgacauagauugcaaaggauaccgcauagacgacagcuacacauucugcuucucccuccacaaguaugaccuuauagcguuccagaaagacgaaaagagcaaagucgaguucgcuuacuacaucaacugcgauuccagcaacggaagauucuaccuagcauggcacgacaaagggagcaaagagcaacaauuuagaaucaguacccaaaaccuaguccucaugcaaaaauaucagauagacgagcucggcaaggaaauacgaccgugccgccuaaagaagcgaccaccagucagauga

SEQ ID NO: 7347 - RNA, 3246 nt, Artificial Sequence
  Cas9 variant
auggcagcguucaagcccaaccccauaaacuauauauugggacuggacaucgggauagccagcguuggaugggcaaugguggaaaucgacgaagaugagaaccccaucugccucaucgaucuaggugucagagucuucgagcgcgccgaaguccccaaaacaggggacagccuagcugcagcacgaagacucgcgcgcuccguccgccggcuaacgcgccgacgggcacaccgacuacuacgagcgcgacgacuacucaaaagagaaggaguacuacaagcagccgacuucgacgagaacggacuaauaaaaucucugcccaauacacccuggcaacuacgcuccgcagcccuggaucgaaaacuuacaccgcucgagugguccgccguccugcugcaucucaucaaacaucgaggguaucugagccaacgaaagaacgagggcgaaaccgccgacaaagaacuaggcgcacuacucaaaggcgucgcaaacaacgcgcaugcccugcaaacuggcgacuuuagaacaccagcagaacuggcucugaauaaauucgagaaagaaagcggacacauacggaaccagcgaggugacuacagccacacauucagccgaaaagaccuccaagcagagcuaauucuccuauucgaaaaacaaaaagaguucgggaacccccacgucaguggaggcuugaaagagggcauagaaacacuacugaugacacagcggcccgcgcucagcggagacgcgguacaaaagaugcuaggacauugcaccuucgagcccgcagaaccgaaagcugccaaaaacaccuacaccgcagaacgcuucauauggcugacaaaacugaacaaccuccguauccuagaacaaggcucggagagaccacucacggacacugaacgcgccacgcuaauggacgaacccuaccgaaaaagcaaacucacauacgcccaagccagaaaauuacucggccucgaagacaccgcauucuucaaaggccuccgguacggcaaagacaacgccgaagccucaacacucauggaaaugaaggccuaucacgcaaucagcagagcccuagaaaaagaaggacuuaaggacaaaaagagcccacucaaccucagcccagaacugcaagacgagaucggcacagcauuuucacuauucaagacggaugaggauauaaccggacgccuaaaagacagaauccaaccggagauccuagaagcacucuuaaaacacauauccuucgauaaauucguccaaaucagccugaaggcacuccgccguaucgucccucuaauggaacaaggaaagcgcuacgacgaagccugcgcagaaauauacggagaccacuacggaaagaaaaacacagaggagaaaauauaccuaccgcccauccccgccgacgaaauacgcaaccccgucguacugagggcgcugagccaagcaagaaaagucaucaacggagucgucaggcgauacggaagccccgcccgcauccacaucgaaacagcacgagaggucgggaagaguuuuaaagaccguaaagagauugaaaaacgccaggaagaaaaccgaaaagacagagaaaaagcagcagcuaaguuccgggaauacuucccaaacuucguaggcgaaccaaagucaaaagacauccuaaagcuacgccuguacgagcaacaacacggaaagugccuguacaguggcaaagagaucaaccuaggccggcucaacgagaaaggauacguagagauagaccacgcccuaccauucagucgaacgugggacgacagcuucaacaacaagguccuaguacucggcuccgagaaccaaaacaaaggcaaccaaacaccguacgaauacuucaacgggaaagacaacagcagggaauggcaagaguuuaaagcccgcguagaaaccuccagauucccgcgcucgaaaaagcaacgaauccuccuccaaaaauucgacgaggacggguucaaagaacgaaaccuaaacgacacuagauacguaaacagauuccucugccaauucguagccgaccgcaugcgccugaccggcaaaggcaagaaacgcguguucgcaucaaacggucaaauuacgaaccugcucagaggcuucuggggccugagaaaaguacgagcagaaaacgaccggcaccacgcacuagacgcuguagugguagcaugcucaacagucgcgaugcaacaaaagaucaccagauucgugcgauacaaagagaugaaugccuucgacggcaaaacaauagacaaagagacgggcgagguccuacaccagaaaacccacuucccacaacccugggaguucuucgcacaggagguaaugauacgggucuucggcaaacccgacggcaaaccggaguucgaagaagcugauacccccgagaaacuccgcacccuacucgccgagaaacuaucauccagacccgaagccguccacgaauacguaaccccgcucuuuguaagcagagcacccaaccgaaaaaugagcggacagggacacauggaaacggucaaaagcgcaaaaaggcuagacgaaggaguaagcguccuucgaguaccacucacccagcuaaaauuaaaagaccuggagaaaauggucaacagagaaagagaacccaaacuauacgaagcacuaaaagcacgacuagaagcccacaaagacgacccagcaaaagcauucgcagagccguucuacaaauacgacaaggcggggaacaggacgcaacaagucaaagccguuagggucgaacaaguccagaaaaccggaguaugggucagaaaccacaauggcaucgcagacaacgccacaaugguaagaguagacguauucgaaaaagccggcaaauacuaccuagugccaaucuacucguggcaagucgccaagggcauccuacccgacagagcaguaguagcauacgcagacgaagaaggauggaccgucauagacgaaucauuucgcuucaaauucguccuuuacuccaacgaucucauaaaaguacaacucaaaaaggacucauuccucggcuacuucaguggccucgaccgggcuacaggggcaaucucccuccgagagcacgaucucgagaaaagcaaagggaaggacggaaugcacagaauaggcgugaaaacagcccuaucguuccaaaaauaccaaaucgacgaaaugggaaaagaaaucagauuaugcaggcucaagaaacgcccacccgugagauga

SEQ ID NO: 7348 - RNA, 3246 nt, Artificial Sequence
  Cas9 variant
auguugaaacgcgugcuuggaauagacgucggaaucucgagcauaggaugggcacugcuagaguuccaaggcgacauagacaacaaggaccuucccuccggcaaaauccucgccagcggagugcgaguguucacacaagcggaaaacccgaaaaauggggaaucacuugcaaaacccaggcgcgacgcacgccuagcuagaaggagaacgcggcgcagagcccagcgccucacggauaucaaagaccucuucuucaaauacaaacugguaacgggcaucucccgaaacaagauaaacucaaucuacaagacggaagaaaauaagaaagacccauggacacuccgcaaagaagcccuguaccgaaaauuagacggagaagaguucgcgagaguacuaacacacauagccaaacaccgcgguuucaaaucaaugaggaaaucggaagaagaaggauccgacaccaaagccaaggaaacucagagaguucuaaccgaaaucggcaaaaacaaagauacacuaaaaaccggcaucuggcaaaccgccggcgaaaugaucgccagcagacccaaaggagacgcgagaagaaacaagacagacucauacaaaaacucaauuucgcgggagcuccuccaggacgaaaccaagaucaucuucgagaagcagcgggggaugaacagccaauucacaagugcagaccuagagaaggaguacagcgacauagcauuccaucaagcccccauccaaagcaugcuaaagauggucgguggcugcacuuuugaaaaagacgaggaaggcaagagacucaaacgcgcgccaaagaacuccuacagcgccgaaguauuuacagcccugacgaagauaaauaaccucguccucaaaacaaaaacagccaacaucaacgaccguuuccucaccacagaagagagaaagaaagcgcuggaacucugccauucaaacgccaaagucacuuuuaaacaguuacgaggggagcuaggccuaccagaggacuggaucuucaacaccguggacuaugcuaagaaacccaagaaaaccgccgucaaagaaacagagccagagagugcaugcuucuuucaaaugcgaggcuacaacgaaauaagaaaaagcgucggaaaagaccuauggacagaaaucagcaugaagaaagagaucuugaacagcauaguuacaacccucgcaacagagaaaagcgacgaagccaucaaagcccaacuuaagaaauccgaaguaccagacgaaauugcagaaaaagugcucggccuaaacuuucgcggauuccuacaccuaagcaucaaagcucucgacaaaauaauccccuucaugauggccggcgacaaauacaccgacgccugcgacaaagccggauacaaagaacaaaucagcggcauuaagaaaauauuccugcgaaaacuaaacgacgaagaaaacgaacaaauaacaaaucccgucgcgaaacgggcaauaacccaguuccguaaaguaaucaacgccauaauacgcgaauacggcaaauucgaccagaugaacaucgaacuggcccgcgacuuggcaaaauccuacgacgaccguaagaaaaucaaagaaggucaagaggacuuccgagccgaaaaagaccgcgcggcacaacggugcaaagacaacggacuagacccaaacuccaaagacaaucucuccaaauacagacuaugggaacaacaagacaacggguucugcauauacugcgggaaacccauagagcuccaaagacuagccgaacaaggcuacugcgaaguugaccacauucuccccuacucgcgaucccuggacgacucccagcauaacaagguacucgcacacauacacgacaaccaacagaaaaagaaccaaauccccuucgaacacuucggcggcgacggcccaaaaugggaggaguucguaggccgacuuaacagccaauucaagaaccuaccaaagagcaaacucaaucgacucgucaagcgcaaguucgaugaaaaagacauggaaggauucaaggaaaggaacauuaacgacacccgauacaucagcagauucaucaaaaacuucgucgaaaaccaccucgaguucgccgaaagcgcccaaaagcaaaagguauucguccgcucuggcagccucacagccuuccuacgccaccaauggggucuaauaaagaaacgagacgaauccgaccgacaccacgcccuugacgcauuagucacagccugcgcgacacaagccauggucaaaucgaccgcaauaaccgcccagaaaauggaauccuacaacuggauaaacaaagaaaaaccccgaaugccccucccauggcucaacuucagagacgauguccaaaagucauuggacgccgucuucguauccagagcaccccgacacaaaguaggaggagccgcccacaaggaaaccauccgcucaauccgaaagugcggagaagagaaccuuaucaucgagaaaacgccacuggucgauauugccacaaagagcggcaucaaacuaaaagacauagagaaacucuacaaaaaggaacaaaaccgaaagcucuacgaaacacucaaagaacgccucgaacaaaacggaaacgauccgguuaaggcguucggcaacccagacgaccccgugcgaaugccgacaaacgaccuaacaaaaacagguccgaucauaaaaagcaucaaacucaucacgaacaagaaauccgggcuaaacguaagagccggcaucgcggacaacggcgaaaucgcacgucucgaugucuacgaacgaaagggaaaauucuaccucauaccaaacuacgucgccgacuucgccaacaaggagcuaccgaagaaagcaaucaaagccaacaccccggaaacagaauggcccauaauagaccgcaauuacaacuuuaaguucucccuuuucaaagacgaccucaucagcaucaaacaaaaacucgacuccccagaggaguucuacuacuacaaaggcccagacguaagcaccgcaagcauaacgguggaaagcguugacagaaaaagacuaugggaagagaaaaagaaaggaaaaauagaaaacgucuuccacacccgaaucggaacaaaaacccucaagagcuuccgcaaguucaaccuggacauccuugggaccaaagcgccgguggaaaucaaaaaggaaaccugggucggcgucauacgcaagaacggcguagccaacaacacaggcaacaaggcaauguga

SEQ ID NO: 7349 - RNA, 3249 nt, Artificial Sequence
  Cas9 variant
auggcagccuucaaacccaaccccaugaacuacauccuaggccuagacauagguaucgcaucggucgggugggcaauggucgaaauagacaaagaagaaaaccccauccgacuaaucgaccuaggaguacggguauucgagcgcgcggagguccccaagaccggagacucccucgccauggcucgacggcuugcccgguccguacguagauugacgcgccgacgagcgcacagacugcuuagggcacgccgccuccuuaagcgagaggguguucuccaggacgccgacuucgacgaaaacggacuugucaagucacuccccaacacacccuggcaacuacgggcagccgcccucgaccgcaagcugacgugccuugaauggucagcaguccuacuacaucucauaaaacaccguggauaccucucccagaggaaaaacgagggcgaaacugcagacaaagaauuaggcgcccuccuaaaaggaguagcggacaacgcccaugcucuccagacaggggacuucagaacgccagcugaacucgcacuaaauaaauucgaaaaggaauccggccacauucgaaaccagcgcggcgacuacucgcauacguucagccgcaaggaccuucaggccgaacuaaaccuacucuucgaaaaacaaaaggaguucuccaauccacauguaucagacagccucaaggaaggcauagaaacacuacuuauggcacaacggccagcacugagcggcgacgccguccagaaaaugcucgggcacugcaccuucgaaccggccgaaccaaaagcagcaaagaacacauacaccgccgaaagguucauauggcuaacaaaacuaaacaaucuaaggauccuagaacaaggaucggaacgaccacucaccgacaccgagagagccacccucauggaugaaccauaccgcaagagcaaacugaccuacgcgcaagcccgaaagcuccucggucucgaagacaccgccuucuucaaaggccuccgcuacggaaaagacaacgccgaggcacccacuuuaauggagaugaaggcauaccacgccaucucgcgagcacuggaaaaagaggggcucaaagacaagaaaagcccacuaaaccucagcacggagcuacaagacgagaucggaaccgcauucucacucuucaaaaccgacaaagacaucacuggccgccucaaagaccgaguccagccggaaauucuagaagcacugcuaaaacacaucuccuucgacaaguucguacaaauaucccucaaagcacuuagaagaaucgucccccuaauggaacaaggaaaaagauaugacgaagcaugcgcugaaauauacggcgaccacuacugcaagaaaaacgccgaggagaaaaucuaccuaccaccgaucccagcagacgaaaucagaaauccugucguccuaagagcccuaagccaagcacgaaaaguaaucaacugcguaguaaggcgcuacggaucuccagcgagaauccacaucgaaaccgcacgagaaguaggaaaaucguucaaggaccgcaaagaaaucgaaaaacgccaagaagagaauaggaaggaccgcgagaaagcggcggccaaauuccgagaauacuuccccaacuucgugggagagcccaaaaguaaggacauccucaaacuuagacuguacgagcaacaacacggaaaaugccuauacuccgggaaagagaucaaccucguaagacucaacgaaaaaggcuacgucgagauagaccaugcauuaccauucucacgcacaugggacgacucauucaacaauaaaguccugguacugggaucagaaaaucaaaacaaaggaaaucaaaccccauacgaauacuucaacggcaaggacaacucacgagaauggcaggaguucaaagcacgcguagaaacuucccgcuucccucggucgaagaaacagcgcauccuccuucagaaauuugacgaagaaggcuucaaagaacgcaaccuaaacgauacacgauacguaaauagauuccucugccaauucgucgcagaccacauacuucuaaccggaaaaggaaaacgccgcguauucgccagcaacggccaaauaacaaaucugcuaagaggguucuggggacucagaaaaguccgcgcggaaaacgaccgacaccacgcccuugacgcggucgucgucgccugcagcaccgucgccaugcaacaaaagaucaccagauucguacgauauaaagaaaugaacgcguucgacgggaaaaccauagauaaagaaacgggggaaguacuacaccaaaaagcacacuucccccaacccugggaguucuucgcgcaggaaguaaugauaagagucuucggcaaaccggacggaaaaccagaguucgaagaagcagacaccccagaaaaacucagaacccuccuagcagaaaaacucagcagccgccccgaggcagugcacgaguacguaacaccccuauucgucucacgcgcaccaaacaggaaaaugagcggccagggccacauggaaacagucaaguccgcuaaacgccucgacgaaggcaucuccguacuaagaguaccccuaacgcagcucaaacucaaaggucucgagaaaauggucaacagagaacgcgaacccaaauuguacgaugcccucaaggcccaacuagaaacacacaaagauaaccccgccaaagcauucgcagaacccuucuacaaguacgacaaagccggcaacaggacccaacaggugaaagccguccgcauagaacagguccaaaagaccggagugugggucagaaaccacaacggcauagccgacaaugcaacgauggugagaguugacguauucgaaaaaggcggcaaguacuaccucguaccaauauacagcuggcaaguggcaaaaggaauacuacccgacagagcaguagucgcauucaaagacgaagaagacuggaccgucauggacgacuccuuugaauuucgauucguacuuuacgcaaacgaccuaauaaaacuaaccgcaaagaagaacgaguuccucggauacuucgucagucuaaacagagcaacgggugccaucgacaucagaacccacgauaccgacagcaccaaaggcaaaaacggcaucuuccaaagcguaggcgucaagaccgcacuaucauuccagaaaaaccagaucgacgagcucgggaaagagauccgacccugccgacugaaaaagcgaccacccguccgcuga

SEQ ID NO: 7350 - RNA, 3249 nt, Artificial Sequence
  Cas9 variant
auggccgccuucaaaccgaacccaaucaacuacauacuaggccuugacaucgggauagcgagcguaggcugggcuaugguagaaauagacgaagaagaaaaccccauccgacuaauagaccuagggguacgcgucuucgaaagggcagaggugccaaaaacaggcgacagccuagcaauggcacggcgccucgcgagaagcgugagacgacuaacgagaagacgcgcacaccgcuugcugcgggcacgaagguuauuaaaacgagaaggcguacuucaagcagccgacuucgacgaaaacggacuaauaaaaucguuacccaacacucccuggcagcuaagggcagcagcccucgaccgcaagcucaccccacucgaaugguccgccguucugcuacaccuaauaaaacacagaggauaucuaucacaacggaaaaacgagggagagaccgcagacaaggagcugggagcguugcugaaaggcgucgccaacaacgcccacgcacuccagacgggagacuuccggacccccgccgaauuagcuuuaaacaaauucgagaaagaaucaggccacauccggaaccaaaggggcgacuacucacacaccuucagucgaaaagaccuccaagcggaacuaauccuacucuucgaaaaacaaaaggaguucggaaacccccacguaucaggaggccuaaaggaagggauagaaaccuugcuaaugacccaacgcccagcucucaguggagacgcagugcagaaaaugcuggggcacugcaccuucgagccagcagagcccaaagccgccaaaaacaccuacacggccgaacgauucauauggcucacaaaacuaaacaaccuacggauacuggagcaaggaucugaaagaccccuaacggacaccgaacgagccacuuuaauggacgaaccguaccgaaaaucgaagcuaacguacgcgcaagcacgcaaacuacuagggcucgaggacacagcauucuucaaaggccuaagauacggcaaggacaacgccgaagcguccacacugauggaaaugaaggccuaccaugccauaucccgcgcccuggaaaaggagggccucaaagacaagaaaagcccacugaaccucuccagcgagcugcaagacgaaaucggcacagcauucucccuguucaaaacagacgaagacaucaccgggcgccugaaagaccgcguccaacccgaaauacuagaggcacugcuaaagcauaucagcuucgacaaguucguccagauaagccuaaaagcacuacgaagaauagucccccugauggaacaaggaaaacgguacgacgaggcuugcgcagaaaucuacggcgaccauuacgggaaaaagaacacggaggaaaagaucuaucuaccaccgauacccgccgaugaaauaagaaacccuguuguccucagagcacucucccaagcaaggaaagucaucaacgggguaguccgaagauacggaagcccggccagaauacacaucgagaccgcgagggaggucggcaaaucauucaaggaccgcaaggaaaucgagaaaaggcaggaagaaaaccgcaaggaucgagaaaaggcggccgccaaauucagagaauauuucccaaacuucguaggagaaccaaaauccaaagacauccucaaacuucgccucuacgaacaacagcacggcaaaugccuguacucuggaaaggaaaucaaccucguacgucucaacgaaaaaggcuacguagaaaucgaccacgcacucccuuucucccggaccugggacgacuccuucaacaauaaagugcuaguacucgguuccgagaaccaaaacaaagggaaccaaacuccuuacgaauacuucaacggcaaagacaacagccgagaguggcaagaguucaaggccagagucgaaacaagccgauucccccgaagcaagaaacaacgaauccuacuccaaaaauucgaugaggacggcuucaaagaguguaaccugaacgauacacgguacgucaacagauuccuaugccaauucguugcagaccacauccuccuaaccggaaagggcaaacgacggguauucgcaagcaacggacaaauaacuaaccuccuccgaggauucuggggccugagaaaaguccgggccgaaaacgaccggcaccacgcacuagacgccguggucgucgcaugcuccaccguagcaaugcaacaaaagauaacacgcuuuguccgguacaaagagaugaacgcauucgacggaaaaacaauagacaaggaaaccggcaaaguacuacaccagaaaacccacuucccccaacccugggaguucuucgcucaagaagugaugauccgugucuucggcaagccggacggcaaacccgaguucgaagaagcggacacaccagaaaaacugcgaacccuacucgccgaaaagcucucaucacgcccagaagcaguacacgaauacguuacaccccuauucgucagcagggcccccaacagaaaaaugucgggacaaggacacauggaaaccgucaagucggcaaaaagacuagacgaaggagucaguguacuaagagugccacucacgcaacucaaacugaaagaccucgaaaagaugguaaacagggaacgcgaaccuaaguuauacgaagcccucaaagcacgccuagaagcacauaaagacgacccggcaaaagcguucgcagaaccauucuacaaauaugacaaagccggcaaccgaacacagcaaguaaaggcaguucgagucgaacaaguccagaaaaccggagugugggucaggaaccacaacggaauagcggacaaugcaacaauggugcgaguggacguauucgaaaaaggcgacaaguacuaccuaguucccaucuacuccuggcaagucgcgaaaggcauacucccagaccgagcagucguacagggaaaagacgaggaagacuggcaacuuaucgacgacagcuucaacuucaaauuuucacuucacccaaacgaccuuguagaggucauaacaaagaaagccagaauguuuggcuacuucgcauccugccaccggggcacaggcaacaucaacaucagaauccacgaccuagaccacaaaaucgggaaaaacggcauacuugaaggaauaggagugaaaaccgcacugagcuuccagaaauaccaaauagacgagcuuggaaaagaaauacgacccugccgccucaagaaacgaccuccuguaagauga

SEQ ID NO: 7351 - RNA, 3249 nt, Artificial Sequence
  Cas9 variant
auggcagcguucaaaccgaauccgauaaacuacauacugggacucgacaucggaaucgcauccgucggcugggccauggucgaaauagacgaagacgaaaaucccauaugccucaucgaucuaggcguccgcgucuucgaacgugcagaaguccccaaaacgggcgacucacuagccauggcacgaagacucgccagaagcguaaggcgccucacacgccgccgggcgcaccgccuguuacgagcacgcaggcugcuaaaaagggaaggcguacugcaagccgccgacuucgacgaaaacggccuuaucaaaucacuaccuaacacacccuggcagcuucgagccgccgcccucgacagaaaacucacuccccuagaguggagcgcgguccugcuacaccuaaucaaacaccgcggauaccucucccagcggaaaaacgaaggggaaaccgccgacaaagaauugggagcccuccucaaaggggucgccgacaacgcccaugcacuacaaaccggcgacuuccgaacccccgcagaacucgcccugaacaaauucgaaaaagaaucaggacacauacgaaaccaacgaggcgauuacucacacaccuucucacgcaaagaccuccaggccgaacuaauccuccuauucgaaaaacaaaaagaguucgguaacccacacgucagcggaggacucaaggaaggcauagaaacucuacucaugacacaaagacccgcgcuaucgggcgaugcgguccagaaaaugcuuggccacugcacauucgaaccagcagaacccaaagcagcgaaaaacaccuacacagcagaacgcuucauauggcuaacaaaauugaacaaccucaggauccuagaacaaggaucggaaagaccuuuaaccgacaccgaacgagcaacccucauggacgaaccguaccggaaauccaaacucacauacgcacaagcaaggaaacugcuaggucuagaagacaccgccuucuucaaaggacuaagauacggcaaagacaacgccgaagcaucaacacucauggaaaugaaggccuaccacgcuauaagccgcgcauuagaaaaggaagggcuaaaggacaagaaaagcccguuaaaccucagucccgagcuccaagacgaaauuggcacggccuucagucuauucaaaaccgacgaggacauaaccggaagacucaaagaccgaauccagcccgaaauacuagaagcacugcugaaacacaucagcuucgacaaauucgugcaaauaucacugaaagcccuccggcguauaguaccccuuauggaacaggguaaacgcuaugacgaagcaugcgccgaaauauacggagaccacuacggcaagaaaaacaccgaagagaaaauauaccuaccaccaauaccagccgacgaaauaagaaacccagucguccucagagcccucucgcaagcacggaaagucaucaacggcguaguacgcagguacggcagcccagcccguauucacaucgaaaccgcacgagaagucggcaaaaguuucaaagaccgcaaggaaauugagaaaagacaggaagaaaaucgaaaggacagagaaaaggcagcagccaaguuccgcgaauacuuucccaacuucgucggcgaaccgaaaucuaaagacauuuuaaaacuccggcucuaugaacaacaacacggaaagugcuuauauuccggcaaagaaauaaaccuaggacgacucaacgaaaaaggguacgucgagaucgaccacgcacuaccauucuccagaacgugggacgauagcuucaacaacaaagucuuaguccugggcagcgaaaaccaaaacaaggggaaccaaacuccauacgaauacuucaacggaaaagacaauagccgagaauggcaagaguuuaaggcccgcgucgaaacaagccgcuucccccgauccaagaaacaacgcauacuguuacaaaaauucgacgaagacggcuucaaagaacgcaaccucaacgacacccgcuacgucaaucgguuccucugucaauucguugcagaccgcaugcgacucacagggaaagggaagaaacgcguauucgccuccaacggucaaaucacaaaucuacugagaggcuucuggggacuccgcaaaguacgagcugagaaugacagacaccacgcccuagacgcagucguggucgccuguucaaccguagccaugcagcagaaaauaacccgauucgugcgauacaaggagaugaacgccuucgacggaaaaaccauugauaaggaaaccggcgagguccuccaccagaaaacccacuucccacaacccugggaguucuucgcccaagaagucaugaucaggguguucgguaaaccagacgggaaacccgaguucgaagaagcagacaccccggaaaaacuacgaacccuccucgccgaaaaacuauccucccgcccagaagccguccacgaauacgucaccccucuauucguaucaagagccccaaauagaaagaugagcggacaaggacacauggaaaccgucaagagcgccaaaagacuggacgagggcgucaguguucucagaguaccgcucacgcaacucaagcucaaagaccuggagaaaaugguaaaccgugaacgagaaccaaagcuauacgaagcucucaaagcacgacuggaagcacacaaagaugacccugcaaaagcguucgccgaacccuucuacaaauacgauaaagcaggaaauaggacacaacaagucaaagcaguccggguagaacaaguacaaaagacaggagucugggugaggaaccacaacgggaucgcggacaacgcuaccaugguacggguagacgucuucgaaaaaggagauaaauacuacuuagugccaauauacagcuggcaaguggccaaaggaauacucccagaccgagccgucguacaaggaaaagacgaagaggacuggcaguuaauugacgacagcuucaacuucaaauuuucacuucaccccaaugacuuggucgaagugaucacaaagaaagcgcgaauguucggauacuucgcaaguugccaccgcggcacaggcaacaucaacauacgcauccacgaucucgaccauaaaauaggcaaaaacggaauccucgaagguaucggcgucaaaaccgcucucagcuuccaaaaauaucagauagacgagcuaggagaagaaauccgccccugccgccuaaagaaacgacccccagugcgcuga

SEQ ID NO: 7352 - RNA, 3249 nt, Artificial Sequence
  Cas9 variant
auggccgccuucaaacccaauccaauaaacuacaucuuaggacuagacauuggaaucgcguccgucggaugggcaaugguggaaauagacgaagacgagaaccccaucugccugauugaucucggcgugagaguauucgaacgcgccgaaguaccaaaaacaggcgacagccuggcgauggcccgacgccuagcacgaagcguccgacgucuaacccgaaggagggcacaccgacuucuccgcgcccgccgccuacucaaacgcgagggcgugcuccaagccgcggacuucgacgagaacggccuuaucaaaucacucccgaacacacccuggcagcuacgagcagccgcccuggaccgaaagcugacgccccuagaauggagcgccguacuccuccaccucauaaagcacaggggauaucuaagccaacggaaaaacgaaggugaaacagcagacaaggaacugggugcccuacuaaagggcguagcggacaaugcccacgcacuacaaacaggcgacuuccgcacccccgccgaacucgcacuaaacaaauuugaaaaggagagcggccacauacgcaaccaaagaggggacuauagccacaccuucucccggaaagaccuacaggcagaauugauucuccuauucgaaaaacaaaaagaauuuggaaacccacacguaucgggaggccugaaggaaggcauagaaacguuacuaaugacacagcggccggcacuaagcggcgacgccguacagaagaugcucggccacugcacuuucgaaccagcggagccaaaagcagcaaagaacacauacacggccgaaagguucauauggcucaccaaacuaaacaaccuccgcauucuagagcaaggcagcgaacgcccacugacagacacggagagggcgacacuaauggaugagcccuacaggaaauccaaacuaaccuacgcccaagcccgaaaacuccuugggcuagaggacacagccuucuucaagggacugcgcuacgggaaagacaacgcggaagccuccacccuaauggaaaugaaggcguaccacgcgaucucacgcgcgcuggaaaaggaaggacuaaaagacaagaaaagcccacucaaccuaagcccggaacuacaagacgaaaucggaaccgcauucagccuauucaaaaccgacgaagacauaaccggaaggcugaaagaccgaauccagccagaaauccuggaggcacuacucaaacacaucagcuucgacaaauuuguacaaauaucccugaaagcguuaagacgcaucgucccccuuauggagcaaggcaagcgauaugacgaggcaugcgccgagauauacggagaccacuacgggaagaaaaacaccgaagagaaaaucuaccucccgcccauccccgcagacgaaauaagaaacccagucguccuacgagcgcugagccaagcaagaaaggucauaaacggaguaguacgacgguacgggucaccggcaagaauacacauagaaaccgcacgagaagucgggaagucguucaaggaucgcaaagagaucgagaagagacaagaagagaacagaaaagacagagaaaaggccgccgccaaauuccgggaauacuucccaaacuucgucggggaaccaaaaagcaaagacauccugaagcuacgccuauaugagcagcaacacggaaagugucuauauucagggaaagaaauaaaccuaggacgacucaacgaaaaagguuacgucgaaaucgaccacgcgcuccccuucagcagaaccugggaugacagcuucaacaacaaagugcuaguacugggcagugagaaccaaaacaaaggcaaccagacaccauacgaguacuucaacggaaaagacaacucgagagaauggcaagaguucaaagcccgcgucgaaaccagccguuucccuagguccaagaaacaacgaauccugcuacagaaauuugaugaagacggcuucaaagaacgcaaccucaaugacacaagguacgucaacagguuccuaugucaguucgucgcagaccgcaugcgacucacgggcaaagggaagaaaagagucuucgcaagcaacggacagauaacuaaccuacucagaggcuucugggggcuaagaaaagugagagcugaaaacgaccggcaccaugcgcucgacgccguagugguagcaugcuccaccguagcaaugcaacagaaaaucacacgauucgugagauauaaagaaaugaacgcuuucgacggaaaaaccauagauaaagagaccggagaagugcuacaucagaaaacacacuucccgcaaccaugggaguucuucgcgcaagaaguaaugauacgcguauucggaaaaccagacggcaaacccgaauuugaagaggccgacaccccagagaaacuccgaacacucuuagccgagaaacuaagcagcaggccagaagcaguacacgaguacguaaccccacucuucguaucacgagcaccaaacagaaaaaugucgggccaaggucacauggagaccgucaagucagcaaagcgauuggacgaaggugucucggugcucagaguaccacuaacacaguuaaaacugaaggaccuugagaaaaugguaaaccgcgaacgagaacccaaacucuacgaagcccuaaaggcacgccuugaagcccauaaagacgacccugccaaggccuucgcugaaccguucuacaaguacgacaaggcagggaaccgaacacaacaaguaaaagccguacgaguagagcaaguacagaaaacgggaguauggguaagaaaucacaacggaauagccgauaacgcgacaaugguaaggguagacgucuucgagaaaggagacaaguauuaccuggucccaauauacagcuggcaaguagcaaaaggcauccuacccgaucgagccguugugcaaggaaaagacgaggaagacuggcaauuaauagacgacagcuucaacuuuaaauucucacuccaucccaacgaccucguagaagugauaacgaagaaagcccgaauguuuggcuacuucgccagcugccacaggggaacgggaaacauaaacauucgcauccaugacuuggaccacaaaauagggaaaaacggaauacucgaaggaaucggagugaaaaccgcccuaucuuuccaaaaauaccaaauugacgaacuugggaaagaaauccgacccugccggcuaaagaaaagaccgccagugcgauga

SEQ ID NO: 7353 - RNA, 3249 nt, Artificial Sequence
  Cas9 variant
auggccgcguucaaaccuaacccgaucaacuacauccuaggcuuggacauuggaaucgcauccgucggaugggcaaugguagagaucgacgaagacgaaaaccccauaugccuaauagaccuaggaguacgcguguucgagagggcagaagugcccaaaaccggcgacucacucgccgccgcacgacgccucgcuagaagugucagacggcuaaccaggaggcgcgcgcaccgacuacuccgagcccgccggcuacucaaacgagagggcguccuccaggccgccgacuucgacgaaaacgggcuaauaaaaucacucccgaacacgccauggcaacuccgugcagccgcacuagacagaaagcuaaccccacuagaguggucagccguacuccuacaccuaauaaaacaccgcggauaccucucccagagaaagaacgagggcgagacggcagacaaagaacuaggagcccuauugaaaggagucgcagauaaugcccaugcccuacaaacaggggacuuucgaacucccgcagaacucgcccucaacaaauucgagaaagaaagcggccauauacggaaccagcgcggagacuacagccacaccuucagucgaaaagaccuccaagcagagcuaauacucuuauuugaaaaacaaaaagaguucggaaacccacacguaagcggcggccugaaagaaggcauagaaacucuccuaaugacgcagagacccgcccuaucaggcgacgccguccaaaagaugcucggucacugcacguucgaaccugccgaacccaaagccgcgaagaacacuuacacagccgaaagauucauauggcugacaaaacugaacaaccucagaauacuagaacagggcagugaacggccacugaccgacaccgaacgcgccacacucauggacgaaccguaccgcaaaucgaagcugaccuacgcccaagcccgaaaauugcucggacucgaagacacagcguucuucaaagggcugcgguauggaaaagacaaugccgaagcauccacccucauggagaugaaagcguaccacgccaucagccgcgcccuagaaaaggagggccugaaagacaagaagucgcccuuaaaccuaucuccagaacuccaggacgaaaucggaacggccuucucacuauucaagacagacgaagacauaacaggacggcuaaaagaccgagugcaaccagaaauccuugaggcccugcucaaacacauuaguuucgacaaauucguacaaauaucacuaaaagcccucaggcgcauagucccgcuaauggaacaaggaaaacgcuaugaugaagcgugcgccgaaauauacggcgaccacuacggaaagaaaaacacagaggagaaaauauacuuaccgcccauaccagccgacgaaauccgcaaccccguaguacuucgagcccugucccaagccagaaaaguaauaaacggggucguccgccgguacggaucaccagccagaauacacauagaaacagcacgcgagguuggaaagagcuucaaggaccgcaaagaaaucgaaaaacgccaggaagagaaccggaaggaucgcgaaaaggcagcagcgaaauuucgagaauacuuccccaacuucgugggcgagccuaagagcaaggacauacucaaacuuaggcucuacgaacaacagcacggcaagugucucuacucgggcaaggaaaucaaccugggacgacucaacgaaaaaggcuauguagaaauugaucaugcacugcccuucucacgaacaugggacgacuccuucaacaacaaaguccuaguacuaggguccgaaaaccaaaacaaagggaaccagacgccguacgaauacuucaacggaaaagacaacucacgagaguggcaagaguucaaagcaaggguagaaaccaguagauucccccgcucgaagaaacaaagaauccugcuacaaaaauucgacgaagacggauucaaagaaagaaaccuaaacgacaccagguacguaaaccgcuuccuaugccaauuuguagcagaccgcaugcgucucaccggcaaagggaagaaaagaguguucgcauccaacggccaaauaaccaaccuacuaagaggauucuggggacuacggaaaguacgcgcggagaacgaccgacaucacgcccucgacgccgucguaguagcgugcagcacaguagcgaugcaacagaaaauaacccgauuugugcgcuacaaagaaaugaacgcguucgauggcaaaacgauagacaaagaaacaggagaaguccuacaccagaaaacacacuucccacaaccaugggaguucuuugcccaagaaguaaugauccgcgucuucggcaaacccgacgggaaaccagaguucgaagaagcagacaccccagaaaagcugaggacacuucucgcagaaaaguuaagcucccggccagaagcaguacaugaauacguaacaccgcuuuucguaagccgagcacccaaccgaaagauguccggacaaggacacauggaaacaguuaaaucggccaagcgacuagacgaaggcgucagcguacuccgcgucccgcugacgcaauugaaacuaaaggaccucgagaaaauggugaaucgcgaacgcgagcccaaacucuacgaagcacucaaggcccggcuugaagcccacaaagacgauccagccaaggcauucgcagagccauuuuacaaauacgacaaagcgggaaacagaacccaacaagucaaagcuguaagaguagaacaaguacaaaagacuggcguauggguccgaaaccacaacggcauagccgacaacgcuaccaugguaagaguagaugucuucgaaaaaggcgacaaauacuaccuaguaccgaucuacagcuggcaaguggccaaggguauccuaccagauagggccguagugcaggggaaagaugaagaggacuggcaauuaaucgaugacagcuucaacuucaaguucucccugcacccuaacgaucucgucgaagucaucaccaagaaagcgcgcauguucggcuacuucgccagcugccaccgcggaaccggaaauauaaacauccguauucacgaccuagaccacaaaaucgggaaaaacggcauccuagaaggaaucgggguuaaaacagcccucagcuuccagaaguaccagaucgacgaacuaggcaaagaaauccgacccugccggcuaaagaagcgacccccggugcgcuga

SEQ ID NO: 7354 - RNA, 3249 nt, Artificial Sequence
  Cas9 variant
auggccgccuucaaacccaacccaaucaacuacauacucggacuagacaucgggaucgcaagcguaggcugggcgaugguagaaauagaugaagaggaaaacccaauacggcuaauagaccuaggaguacgcgucuucgaacgggcagagguacccaaaacgggcgacagccucgcgauggcgcggcgacucgcgcgcagcguacggcgccucacgcgccgccgcgcccaccgccuacuccgaaccagaagacuacucaaaagagaaggcguacuccaagccgcuaauuucgacgaaaacggccucaucaaaagccugccgaacacccuauggcaacucagggcagccgcccuggacagaaaacuaacaccccucgaauggagcgccguccugcugcaccucauaaaacaccggggauaccuaucccaacgcaaaaacgaaggagaaacagcagacaaagagcucggagcacuccucaaaggagucgcaggcaacgcccaugcccuacaaaccggagacuuuaggaccccggccgaacuggcccugaacaaauuugaaaaagaaaguggacacauaaggaaccagcgcggcgacuauagucacaccuucucacgcaaggaccugcaagcagaguuaaacuuacuuuucgaaaagcagaaagaguucggcaacccacacaucagcgacggccucaaagaaggcaucgaaacacugcuaaugacacaaagaccugcccucuccggagacgcaguccagaaaaugcuaggccauugcacauucgaacccacggaaccaaaggcagccaagaacaccuacacgacagaacgauucauauggcucacaaaacucaacaacuuaaggauauuagaacaaggaagcgaacgcccacucacagacaccgaacgcgccacgcucauggacgaacccuacagaaaaaguaagcugaccuacgcccaagcccgaaaacuacuagagcuagacgacauagcauucuucaagggacugcgguacggcaaagacaaugcggaggccagcacgcuaauggaaaugaaagccuaccacgcgaucuccagagcccucgagaaagaaggccuaaaagacaagaaaagcccccugaaucucucaccagaacuacaagacgaaaucggcaccgcauuuagucuauuuaaaacagacgaagauauuaccggccgacucaaagaccgaauacaaccagaaauacucgaggcccugcucaagcacauaaauuucgauaaguucguccaaauaagccugaaagcgcuccggcggauagugcccuuaauggaacaaggaaaacgguacgacgaagcaugcgccgaaauauacggggaccacuacggcaagaaaaacaccgaagagaaaaucgaccucccgccaauucccgcggacgaaauacacaaccccgucguccucagggcacuaucccaagcaagaaaggucauaaacggcgucguacgaagauacggcagcccggcccggauacacauugaaacagccagagaagucggcaaaucauucaaagaccgaaaagaaauugagaaaaggcaagaagaaaaccgaaaagacagggaaaaagcggcggcaaaauucagagaauacuuccccaacuucgucggcgagccaaaaucaaaggacauccuaaagcuaagacucuacgaacaacagcacggcaagugucucuauucaggcaaagaaauuaaccuagggcgacuaaacgaaaaaggguaugucgaaauagaccacgcucugccauucagcaggacaugggacgacuccuuuaacaacaaaguccuagugcucggaagcgaaaaccaaaacaagggcaaccaaacaccauacgaauacuucaacggcaaagacaacagccgggaauggcaagaguucaaagcacguguggaaaccucccgcuucccccggagcaagaaacaacgaauacuccuccagaaauucgacgaagauggauucaaagaacggaaccuaaacgacacacgcuacguaaaccgauucuuaugccaguucgucgccgacaggaugcgccugaccgggaaagguaagaagagggucuucgcgucaaacggccagauaacgaaucuacuaagaggauucuggggacuccguaaggucagagcggagaacgaccggcaccacgcacuggacgcagucguaguagccugcuccacggucgccaugcaacagaaaauaacacgauucguucgcuacaaagagaugaacgcauucgacgggaagacaaucgacaaagagacaggagaaguacuacaucagaaaacacacuucccacaaccuugggaguucuuugcccaggaagucaugauccgcguauucgggaagcccgacggcaaaccagaguucgaagaagccgacacccccgaaaagcugaggacacugcugacggaaaaacucucaucacgcccggaagccguucacgaauacgugacaccccucuucgugucaagggcacccaaccgaaaaaugucaggacaagggcacauggaaaccguaaaguccgcaaaaagacuagacgagggcaucucaguccucagaguaccgcuaacccaacuaaaacuaaaagaccuugagaaaauggucaaccgugaacgagaaccaaagcuguacgaagccuuaaaggcaaggcuagaggcacacaaagacgaccccgcgaaggcuuucgccgaaccauucuacaaauacgauaaagccggcaacaggacacaacaagugaaagcaaugaggguagaacaaguacaaaagaccggagucuggguccgcaaccacaacggaaucgccgacaaugcaaccaugguacgaguggacgucuucgaaaaaggcgacaaauacuaccucgucccaaucuacucuuggcaggucgccaagggcauccugccggauagagccguaguacaaggcaaagaugaagaagacuggcaacuaaucgacgacuccuucaacuucaaguucagccuucaccccaacgaccuaguagaagucaucacuaaaaaggcccgcauguucggauacuuugcaagcugccaccgaggcaccggcaacauaaacaucagaauacacgaccuggaccacaagauaggcaaaaacggaauacuagaaggcauaggaguaaagaccgcauugagcuuccaaaaguaucaaauagacgaauuaggcaaagaaaucagacccugcaggcuaaagaaacgcccgcccguaagauga

SEQ ID NO: 7355 - RNA, 3249 nt, Artificial Sequence
  Cas9 variant
auggccgccuucaaacccaaccccauaaacuacauauugggacuagacauaggcauagcgucagugggaugggccaugguggaaauagaugaagacgaaaauccuaucugcuugaucgaccucggcguaagagucuucgagcgcgcugaagugccgaagaccggggacagccucgccauggcaagacgacucgcaagaucgguccgccgacuaacgcggcgacgcgcucaccgccuccuccgcgcucgaagacugcuaaaacgagagggcguuuuacaagcggcggacuucgaugagaacggacucauaaaaagccucccgaacacacccuggcaguuacgcgcggccgcgcucgaccgaaaacucacgccccucgaauggagcgcaguccugcuccaccuuauaaagcaccgcggauacuuaucacaacgcaagaacgaaggcgaaacagcagacaaagagcugggcgcacuccugaaaggcgucgccgauaacgcccacgcgcuacaaaccggcgacuucaggacacccgcugaacucgcacucaacaaauuugaaaaagagagcggucacauccgaaaccaaaggggcgacuacucgcacacauucagucgcaaggaccuccaagccgaacuaaaccuccucuucgaaaaacaaaaggaauuuggcaauccgcacaucucggauggccucaaagagggaauagaaacccuccuaaugacacaacgaccggcccugucaggagacgccguccagaaaaugcucggacacugcacauucgaaccagcggaacccaaagccgccaagaacacauauacagccgaacgcuucauauggcuaaccaagcuaaacaaccuuagaauauuagaacaaggcucagaaaggccauuaacagacaccgagcgaacuacucugaucgacgagccauauagaaagagcaaacucaccuacgcccaggcaagaaaacuucucgaacuagacaacaccgcauucuucaaaggccuacgcuacggcaaagacaacgcagaggcaagcacucucauggagaugaaagcauaccacgccaucagcagagcccuugagaaagaaggccucaaagacaagaaaucgcccuuaaaccugucacccgagcuccaggacgagaucggcaccgccuucagccucuucaaaacagacgaagacauaaccggacggcucaaagacaggguacaaccagaaauacucgaagcccuacucaagcacauaaguuuugacaaguucguccaaauaagccucaaagcccuaagaagaaucgucccccucauggaacagggaaagcgcuacgacgaggccugugccgagaucuacggggaccauuacgggaagaaaaacaccgaagagaaaaucgaucuacccccgauacccgccgacgagaucaggaacccggucguccugcgcgcacuaagucaagcacgaaaagugauaaacggcguggugagacgauacggcucaccagcacgaauacacauagagacggcacgagaagucggcaaauccuucaaggaccgaaaagaaaucgaaaaacgccaagaagaaaacagaaaagaccgagagaaagccgccacaaaauuucgcgaguauuucccaaacuuugucggcgaacccaaguccaaggacauacucaaacuucgucuguaugaacagcaacacggaaaaugucuguacagcggaaaagaaauaaaccugggaaggcugaaugaaaaaggauacgucgaaauagaucacgcacuccccuucucccgaacuugggacgacagcuucaacaacaaaguccucguauuaggcuccgaaaaccaaaacaaaggaaaccaaacacccuacgaauacuucaacggcaaagacaacagucgagaguggcaagaguucaaagcccgaguagaaacgagcagauucccacgcagcaagaaacaacgaauacuccuacaaaaauucgacgaagaaggcuucaaagaaaggaaccuaaaugacacgcgauacgucaaccgauuccuaugccaauucgucgccgaccacauguuacucaccggcaaaggcaaaagaagggucuucgccagcaacggucaaaucaccaaccuacucagaggcuucuggggccuaaggaaaguccgagccgaaaaugacaggcaccaugcccuggacgccgugguagucgcaugcagcacaguggccaugcaacaaaagaucacccgcuucguaagauauaaagaaaugaacgccuuugacggcaaaacuaucgacaaagaaacaggcgaaguacuacaccagaaaacacacuuuccccaaccuugggaguuuuucgcccaagaaguaaugaucagaguauucggcaagcccgacggaaagccagaguucgaagaagcagacacccccgaaaagcuacggacccuacucgcugaaaaacucagcagcagaccagaagccguacacgaauacgucaccccacucuucguaucccgagcacccaaccgcaagaugucgggacaagggcacauggaaacggucaagagcgcaaagagacucgacgaaggaguguccguacucagagucccgcugacgcaacucaaacuuaaagaucucgagaaaaugguaaaccgcgaacgugaaccaaaacucuacgaagcccucaaagccagacuugaagcccacaaggacgacccagcgaaagcauucgcggaaccauucuacaaauacgacaaggccgggaaccgaacgcaacaagucaaagccgugcgagucgaacaaguccagaagaccggugucuggguccgaaaccacaacggcauagcagauaacgccaccauggugcggguagacguauucgaaaaaggagacaaauacuaccucguccccaucuauagcuggcaaguagcaaaaggcauccucccagaccgagccguaguccaaggaaaggacgaagaagacuggcaacuaaucgacgacuccuucaacuucaaauucagccuucacccaaaugaccuagucgaagugaucaccaagaaagcucgcauguucggauacuucgccagcugccaccggggcacggggaacaucaacaucaggauccacgaccucgaccacaaaaucgggaaaaacggaaucuuagaaggcaucggcgucaaaaccgcacucagcuuccaaaaauaucaaaucgacgaacuuggaaaagaaauaaggcccugcaggcugaagaaacggccacccguccgcuga

SEQ ID NO: 7356 - RNA, 3249 nt, Artificial Sequence
  Cas9 variant
auggccgcuuucaaaccgaacccgaugaacuacauccucggccuagacaucggaauagcuucggucggaugggcaaucgucgagauagacgaggaagagaacccgaucagacuuaucgaucuaggaguucgugucuucgaacgagcagaagugccaaaaacaggagacucacucgccgccgcgcgacgacuagcccgaagcguucggaggcugacccgccggagagcccaucgacuucugcgcgcacgacgccuccuuaaacgagaaggcguccugcaagccgcagacuucgacgagaacggacucauaaaaagccucccgaacacaccguggcagcuacgcgcggcggcacuagaccgcaaacucacuccccuagaauggagcgcuguccucuuacaccuaaucaaacaucggggcuaccugucacagcgcaagaaugaaggcgaaaccgccgacaaagaacuaggugcgcugcuaaagggcguagccgacaacacacacgcccuccaaacuggagacuuccggacgccugcagagcuggcacugaacaaauucgagaaagaaagcggacacaucagaaaccaacgcggagacuacucacauaccuucaacaggaaagaccugcaagccgagcucaaccuccuauucgaaaaacagaaggaguucggaaacccccacgucucagacggucuaaaagaaggaaucgaaacgcuacuaaugacgcaaagaccagccuuauccggagacgcaguacaaaagaugcuagggcacugcacauucgaacccacggaacccaaggccgccaagaauacauacaccgcugaacgcuucguauggcucacaaaacucaacaaccugcgcauucuagaacaaggcagcgaacgaccccugacggauacggaacgagcaacccucauggacgaacccuaccgcaaaagcaaguuaacauacgcccaagcucggaaacucuuagaccucgacgacacagcguucuucaaagggcugagauacggcaaagacaacgcggaagcaaguacccucauggaaaugaaggccuaccacgccauaagccgagcacuugaaaaagaaggacuaaaggacaagaaaucaccccucaaucucaguccagaacuccaggacgagaucggaacagcauucuccuuauucaaaacagaugaagacaucaccgggcgacuaaaagaucguguccaacccgaaauacuagaagcccugcuaaaacacaucuccuucgacaaauuuguucagaucagccucaaagcacucagacggaucguaccucucauggaacagggaaacagauaugacgaggcaugcacagaaaucuacggagaccacuacggaaagaaaaacaccgaggagaaaauuuaccuacccccgauaccggccgacgaaauccgaaaccccguaguacuccgagcacugagucaagcccgcaaagucaucaacggcguggucagacgauacggaucuccugcaagaauacauauugaaaccgcccgagaaguaggaaaauccuucaaagaucgaaaagaaauagaaaagaggcaagaagagaaccgcaaagacagagagaaaucagcagcaaaauuucgagaguauuucccaaauuucgugggggaaccaaaaagcaaagacauacucaagcuccgucucuacgaacagcagcauggcaagugccucuacucgggcaaagagauaaaccucgggagacuaaacgagaaaggguacguagaaaucgaccacgcgcugcccuucuccagaaccugggaugacagcuucaauaacaaaguccucgcauuaggcagcgaaaaucagaacaagggcaaccaaaccccauacgaauacuuuaacggcaaagacaacucccgagaauggcaagaauuuaaagcgcgggucgaaacgucccgauucccccgcagcaagaaacagcgcauccuccuacaaaaauucgacgaagacggguuuaaagagcgaaaccucaacgacacucguuacaucaaccgcuuucuaugccaguucguggccgaccacaugcuacugacaggcaaaggcaaaagacggguguucgcaucaaacggacaaauaacuaacuuacuacggggcuucuggggacuccgaaaaguacgcgcugagaacgaccgacaccacgcacucgacgcaguggucgucgcgugcucaacaauagcgaugcaacagaaaauuaccagauucguccgauauaaagaaaugaacgccuucgaugggaaaaccaucgacaaagaaacaggagaaguccuccaccaaaaagcccacuucccacaacccugggaguucuuugcccaagaaguaaugauacgcgucuucggcaaacccgacggcaaaccggaguucgaagaagcagauacccccgaaaaacugcgaacacuccuagcggaaaaacucagcagccgaccagaggccguacacaaauacgucacaccccuauucauauccagagcacccaacagaaaaaugucgggccaaggacacauggaaacuguaaaaucagcgaagaggcucgaugaaggaauauccguccucagagugccucuaacacaacugaagcuaaaagaccucgagaaaaugguaaaccgagaacgagaacccaaacuguaugaagccuuaaaagcccggcuagaggcacacaaggacgaccccgccaaagccuucgccgagccguuuuacaaauacgacaaggcgggcaaccgaacccaacaaguaaaagccguccgggucgaacagguacagaaaacgggcguauggguacacaaccacaacggcaucgccgacaaugccacaauagugagagucgacgucuucgaaaaaggcggaaaauacuaccuaguaccaaucuauucauggcaaguagcaaaaggcauucugcccgacagggccgucguacagggaaaagacgaagaagacuggacgguaauggacgacucuuucgaguucaaauucgugcucuacgcaaacgaccuaaucaagcucaccgccaagaaaaacgaauuucugggauacuucgugagccucaaccgggcaaccggagcaaucgacauccgaacccacgauacggacucgaccaaagguaaaaacgggaucuuccaaagcguaggagucaaaaccgcccucucauuccaaaaauaccaaauagacgaacuaggcaaagagauccggcccugcagacucaagaaacgacccccgguccgcuga

SEQ ID NO: 7357 - RNA, 3249 nt, Artificial Sequence
  Cas9 variant
auggcggccuucaaacccaacuccauaaacuacauauuaggccucgacauaggcauagcgaguguaggaugggccauggucgagauagacaaagaggagaacccaauucgacugauagaccugggcguacgcgucuucgaacgggcagaggucccaaaaaccggagacagucuagcagcggcccgcagacucgcgcguagcguccgacguuuaacaagaagaagggcccaccgacuacuccgcacucgccggcuccucaaacgcgaaggcguccugcaagcagcaaacuucgacaaaaacgggcucaucaaaagccugccaaauacccuauggcagcuuagagcagcggcccuggaucggaaacugacaccacuagaauggagcgcuguccuacuccaccugauaaagcacaggggauaccucucacaacgcaaaaacgaaggugaaaccgcagacaaagaacuuggagcccuccucaaaggcgucgccggaaacgcgcacgcccuccaaaccggagacuuccgcacacccgcagaacuagcccugaacaaauucgaaaaagaguccggacauauccgaaaccaaagaggagacuacucccacacauucucgcgcaaagaucuccaagcggaacucaaccuccuauuugaaaagcaaaaagaguucggcaacccacacauuuccgguggccucaaagaaggcaucgaaacacuccugaugacacaacggcccgcccuaucaggggacgccguccagaaaaugcuaggacacugcacguucgaacccaccgaaccaaaagccgcuaaaaacaccuauaccacggaacgauucaucuggcuaacaaaacucaacaaccugcgaauccuagagcaagguagcgaacgcccacucacggacacagaacgggccacgcuuauggacgagccauaucgcaagucaaaacuaaccuaugcacaagccaggaaacuccugucccuagaggacacagcauucuucaaaggacuccgcuacggcaaagacaacgccgaagccaguacacuaauggaaaugaaggccuaccacaccaucucacgcgcacuagaaaaagaaggccuaaaagacaaaaagucaccacucaaccuuucacccgagcuccaagacgaaaucggcacggcauuuagccuguucaaaaccgacgaagacaucaccggccgucuuaaggaucguauacaaccagaaauccucgaagccuuacuaaaacacaucagcuucgacaaauucguacaaaucagccuaaaagcucuccgcagaauagucccccugauggaacaagguaaaagauacgacgaagccugcgcggaaaucuacggagaucacuacggaaagaaaaacacagaagagaaaaucuaccuacccccaauacccgccgacgagauacgcaaccccguaguccuccgcgcccuuucacaagcccgcaagguaauaaacggugucguucggcgauacgggagcccagccaggauccacauugaaaccgcgcgcgaggucggaaagaguuucaaagaccgaaaagagauagaaaaacgucaagaagaaaaccgaaaagacagggaaaaagccgcagcgaaauuccgggaauacuuccccaacuucgucggagagcccaagagcaaagacauccuaaaacuacgccuguacgaacaacaacacggcaaaugccuauacuccgguaaagaaaucaaccuaguccgacucaacgaaaaaggauacgucgaaauagaccaugcccuuccguucagccgaaccugggacgacagcuuuaacaacaaaguccucguacucgggagcgaaaaccaaaacaaaggaaaccaaacgccuuacgaauacuucaacggcaaggacaacagccgagaguggcaagaguucaaagcaagagucgaaacaagccgauucccccgaagcaaaaagcaacgaauacuacuacaaaaauucgacgaggauggguucaaggaacgaaacuuaaacgacacccgauacgugaaccgcuuccuaugccaauucgucgcggaccauauacuacucacagguaaagggaaacguagggucuucgccuccaacgggcaaaucaccaaccuccuucggggcuucuggggccuacgaaaaguccgggcagaaaacgaccgacaccacgcucuggacgcagucgucguggcaugcagcacagucgccaugcaacagaagauaacacgguucguacgauacaaagaaaugaacgcguucgauggaaaaacgauagauaaagaaaccggcgaaguccuacaccagaaaacccacuucccacaacccugggaguucuuugcccaagaaguaaugauccgagucuucggcaagcccgauggcaaaccugaguucgaagaagcggacacgcucgaaaaacuccgcacccuacucgcagaaaaacuaagcucgcgacccgaagcaguacacgaauacguaaccccauuauuuguaucacgcgcccccaauagaaaaaugaguggccaaggucacauggaaacagucaagagcgcgaaacgacuagaugaaggcgucucgguacuccgagugccccucacucaacuaaaacugaaagaucuagagaaaauggugaauagagaacgagaacccaaacuguacgaagcacucaaggcgaggcuagaagcccacaaggaugacccagcgaaagccuucgccgaacccuucuacaaguaugacaaagcagguaaccgaacacagcagguaaaagcgguccgcguagaacaaguccaaaagacugggguguggguacguaaccacaacgguauagcagauaacgcaacaaugguccgcgucgacgucuucgaaaaaggcgacaaauacuaccucgugccgaucuacuccuggcagguagcaaaaggaaucuuaccagaccgcgcggucguacaaggaaaagacgaagaagauuggcaacucaucgaugacucauucaacuucaaguucucgcuacacccgaaugaccucguagaagucauaaccaagaaagcgcgaauguucggauacuucgcaagcugccaccgcggcacgggaaacauaaacauccggauacacgaccuugaccacaaaaucggcaaaaacggaauacuagagggaauaggcguaaaaacagcgcucagcuuucagaaauaccagaucgacgaacuuggaaaagaaauccguccuugcaggcucaaaaagcggccuccagucagguga

SEQ ID NO: 7358 - RNA, 3249 nt, Artificial Sequence
  Cas9 variant
auggcagccuucaaaccaaacccuauaaacuacauacuuggguuggacauagggauugcaaguguaggcugggcaauggucgaaauagacgaggaagaaaacccuauacgccucauagaccugggcgucagaguauucgaacgagcagaaguacccaaaaccggggacucccuggccauggugcggagacucgccaggucaguacgcagacuaacaaggagacgagcccacaggcuacuacgcgcuagacgccuacuaaaacgcgaaggcguccuccaagccgcagacuucgacgaaaacggccuaauuaaauccuuaccaaacacgccauggcaacuccgcgccgcagcacucgaccgaaaguuaacgccacuagaauggagcgcaguccuccuacaccucauuaaacaccggggcuaccucagccagcgcaaaaacgagggagaaaccgccgacaaggaacucggugcccuccuaaagggugucgcggacaacgcacacgcccuccaaacaggagacuucaggaccccugcagaacuggcccucaacaaauuugaaaaagaaagcggccacauccgcaaccagcgcggagacuauagccacacauucucccgaaaagaucuccaagccgaacuaauacuccuguucgaaaaacaaaaagaguucggaaacccccacauaagcggcgggcucaaggaagguauagaaacgcuacucaugacacagcguccagcgcuaaguggagacgccgugcagaaaaugcucggccacugcacguucgaacccgcagaaccgaaagccgcgaaaaacacauacaccgcggaacgauucaucuggcuaacgaaacucaacaaccuccguauccucgaacaaggcagcgagcgcccauuaacugacaccgaaagagccacccucauggacgaaccauaccgcaaaucgaaacugaccuacgcacaagccagaaaacuucucggacucgaggacacggcauuuuucaaaggacuacgcuacggcaaagacaacgcagaagccuccacccugauggagaugaaggccuaucacgccauuucgcgcgcgcucgaaaaagaaggcuugaaagacaaaaaguccccguugaaccuaagucccgaacuccaggacgaaaucggcacggcauucagcuuauucaaaaccgacgaggacauuaccggccgccuuaaagaccgcauacaaccggagauacucgaagcucuccugaaacacauuagcuucgacaaauucguacagaucagcuuaaaagcgcuccgaagaauagucccccucauggaacaaggcaaaagauacgacgaggcaugcgcugaaauauacggcgaucacuacgggaagaaaaacaccgaagaaaagauauaccuaccacccauacccgccgacgaaauccgaaaccccguaguacuccgagcccucagccaagcccgaaaagucaucaacggaguagugcgcagauauggcuccccagccagaauccacauagaaacagcacgugaagucggaaagagcuucaaagaucgaaaagagauagagaagcgacaagaggaaaaccgaaaagaccgcgaaaaagcagcagccaaguuccgcgaguacuuuccaaacuucgugggcgagcccaaaucaaaagacauccuaaaacugcgacuauacgaacaacaacacggcaaaugucucuacagcggaaaggaaauaaaccuaggccgacucaacgaaaaaggguacgucgagaucgaccacgcacuaccauucucaaggaccugggacgacuccuucaacaacaaaguccucguuuuaggcucagaaaaccaaaauaaagggaaccaaacgcccuacgaauacuucaacggcaaggacaacucacgcgaguggcaagaguucaaagcucgcguagaaacuagccgcuucccacggucaaagaaacaaaggaucuugcuccagaaauucgacgaagacggcuucaaagagcgcaaucucaacgacacucgcuacgucaaccgauuucucugccaguucguagccgaucgcaugaggcuaaccggcaaaggcaaaaagcgugucuucgcgagcaacggacaaaucaccaaucuucuaaggggauucugggggcugcgcaaaguaagagcugagaacgaccgacaccacgcacucgacgcagucguaguugcgugcuccaccgucgcgaugcaacaaaagauaacccgcuucguccgguacaaagaaaugaaugcuuucgauggcaaaaccaucgacaaagaaacgggcgaaguccuacaccagaaaacccacuucccccaaccgugggaguucuucgcacaagaagucaugauacgggucuucggcaaacccgacggcaagcccgaguucgaagaagccgacacaccggaaaaauuaagaacccuccucgcagaaaaacuaagcuccagaccugaagcggugcaugaauacgucacgccgcucuuugucucucgugcgcccaaccgcaagauguccggccaaggccauauggaaaccguaaaaagcgccaaacgacucgacgaaggcguaagcguccuacggguaccgcuaacccagcucaaauuaaaagaccuugaaaagaugguuaaccgcgaacgagaacccaagcucuacgaagcccuuaaagcccgccuggaagcacacaaagacgacccggccaaggccuucgccgaacccuucuacaaauacgacaaagcaggcaacagaacccaacaaguaaaagccguacgcgucgaacaaguccagaaaaccggcguguggguacggaaccacaacgggauagccgacaacgcaacaaugguaagggucgacgucuuugaaaaaggagacaaauacuaccuagucccgauauacagcuggcaagucgcaaaagggauccucccagaccgagcagucguacaaggaaaagacgaagaagacuggcaacucaucgacgacucuuucaacuucaaauucagccuacaccccaaugauuuagucgaaguaaucacuaaaaaggcaagaauguucggauauuucgcaagcugccaccgcggcaccggcaauaucaauauccgaauacacgaccuugaccacaaaauagggaagaacgggauacucgaaggaaucggcgucaaaaccgcacucucauuucaaaaauaccaaauagacgaacuaggaaaagaaaucagacccugccgacucaaaaagcgaccacccguacgguga

SEQ ID NO: 7359 - RNA, 3249 nt, Artificial Sequence
  Cas9 variant
augcgcguacuaggacuagacgcggggauagcaagccugggcugggcccugauagagauagaagaaagcaaccggggagaacugagccaagggaccaucaucggggcagggacguggauguucgacgcaccagaggagaaaacccaagcaggagcaaaacugaaaagcgaacagaggagaacauucaggggccaaagaagaguggugagaaggcgacgccagagaaugaaugaggucaggagaauccuacacagccacggacugcugccuagcagugauagagacgcacugaaacaacccggacucgacccauggaggauacgagccgaagcacuggaccgacuccuuggacccgucgagcuggcgguggcacucggccauaucgcccgacaccgaggauucaaaagcaacucuaaaggggcaaagacaaacgauccagcggacgauaccucgaaaaugaaaagagccgucaacgagacuagggaaaaacuagcaagauucgggucggccgcaaagauguuaguggaggaugagagcuucguacucagacagaccccaacgaagaacggggcaagcgaaauagucaggagguuccgaaauagagaaggagacuacagcagaagucuacuaagagacgaccuggcggcagaaaugagggcacuauucaccgcgcaggcaagauuccaaagugcaauagcgacagcggaccugcaaacagcauuuacgaaggccgccuucuuccagcgaccguuacaagacagcgaaaagcuagucgggcccugcccauucgagguggacgaaaagcgagccccaaaaagagguuacagcuuugaacuguuccgguuccuaagccgacuaaaucacguaacacuaagggacggcaaacaagaacgaacacucacaagagacgaacuagcacuagcggcggcagacuucggggcagccgcgaaagugagcuucacagcacuacgcaagaaacugaaacugccggaaaccacaguauucguaggggugaaggcggacgaagaaucaaaacuagacguaguagcaaggagcgggaaggcggcagaaggaacggcgcgacucagguccgugaucgucgaugcacucggggaacuagccuggggagcacuacugugcucacccgaaaaacuagauaagaucgccgaaguuaucagcuuuagaagcgauauaggccgaauaagcgaagggcuggcgcaggcaggaugcaacgcgccauuaguggacgcacuuacggcagccgcguccgauggccgauucgauccguucacaggagcaggacacauaagcucaaaggcggcccgcaacauacuguccggacugcgacaggggaugacauacgauaaagccugcugugcggcggacuacgaccacacggcgucacgggaacgaggagcauuugacgucggugggcacggaagagaggcacuaaaacguauauuacaagaggaacggaucagccgggaacugguaggcagcccaacagcaagaaaagcgcuaauagaaaguauaaaacaaguaaaagccauaguggaaagauauggagugccagacagaauccacgucgaacuggcccgagacgugggaaaaagcauagaagaaagagaagaaauaacaaggggaauugaaaaacgaaaucgccaaaaagacaaacugcgaggccucuucgaaaaagaaguagggcgcccgccacaagacggagcgagagguaaagaggagcuacuacgguucgaacuauggagcgaacaaaugggacggugccuguacacggacgacuacauuaguccgagccagcuggucgcgacagacgacgccguccaggucgaccacauauugcccuggagcagauucgcagacgauucguacgccaacaaaacgcucuguauggcgaaggcaaaccaagauaagaaagggaggacgcccuacgaaugguucaaagcagagaaaacagacacagagugggacgcguucaucguacgcguagaagcgcucgcagacaugaaaggguucaagaaacggaacuauaaacugcgaaacgcagaagaggcugcggcgaaauucagaaacagaaaccugaacgacacgaggugggcaugcagacuccuagccgaggcacuaaaacaacucuacccgaaaggagagaaagauaaggacgggaaggagagaagacgggucuuuagcaggccaggagcgcugaccgaccgccugcgcagggcuugggggcugcaauggaugaagaaaagcacaaaaggagacaggauaccagacgacagacaucaugcacuggacgcgauagugaucgcggcaacaaccgaaucauugcuccaaagagcaacucgagaaguacaggaaaucgaagauaaaggcuuacacuacgaucuagucaaaaacgugacaccacccuggcccggguuucgggaacaggccgucgaggcaguagagaaaguguucguagcaagggcagagcggcgccgagcaagaggcaaagcgcacgacgcgacgauacgucacauagcaguaagggaaggagagcagagaguauacgaaagacggaaagucgcugaacuaaagcuggccgaccuggaccgagugaaagacgcggagcgaaaugccaggcucauagagaaguuaaggaacuggaucgaggcgggaucuccaaaggacgacccgccacuaagcccaaaaggggacccaauauucaaagugcgacugguaacaaaaucaaaaguaaacaucgcacuggacacaggaaacccaaaaagaccaggcacgguagaccgcggcgaaauggcaagaguggacguguuucggaaggccagcaagaaagggaaauacgaguacuaccugguaccaauauacccacaugauauagcgacgaugaaaacgccaccaauccgggccguccaagcauacaaaccggaagacgaauggccggagauggacucaaguuacgaguucuguuggagccuggugccgaugacguacuuacaggugaucagcagcaaaggggagaucuuugaaggguauuacagaggaaugaacagaucgguaggggccauacaguuaagcgcacacucaaacaguucggacguaguacaaggaaucggggcacggacccugaccgaguucaaaaaguuuaauguggaccgcuuuggacgaaagcacgaaguggaacgagaacuacguaccuggagaggggagacauggagggggaaagcguauaucuga

SEQ ID NO: 7360 - RNA, 3255 nt, Artificial Sequence
  Cas9 variant
augaaaaacacccucuacggcauaggacucgacauaggcgucgccagcguaggaugggcugucgucggccuaaacggcacaggggaaccagucggccuccaccgccuuggaguccggaucuucgacaaagcggaacaaccaaagacgggcgaaagccucgccgccccaagacgcauggcacgcggaaugcgaagacgucuccgacggaaggcacuaagacgcgcagacgucuaugcacugcucgagcgaucuggccucagcacacgcgaagcgcucgcacacauguucgaagccggcgggcucgaggacaucuacgcacucagaacgagagcacuagaugaaccgguaggcaaggcggaguucuccagaauacuccuccaccuggcccaacggcgaggauuuaaaagcaaccgucgaacagccucugauggagaagacggacgccuccucgcagcaguaaacgaaaaccgaagacgaauggcacaaggaggcuggcgaacugucggagaaaugcuguaucgccacgaagcauucgcauuacacaagcgaaacaaagcggacgaauaucucagcacugucgggcgagacaugguagcggaagaagcgagccuacuauuccaaagacagagagaguuaggcugcgcaugggccaccccggaacuacaggcagaauaccuaaguauccuacuaagacaacgcagcuucgacgaaggacccggagggaacagccccuauggaggcaaccagguagagaaaaugguaggacguugcacauucgaacccgacgagccccgagcagcaaaggccgcauacuccuucgaauacuucagucugcuccagaaaauaaaccacauaagacucgucgagaacggcgaaacacgaccccucacgcaacaacaacgacaacagcuccucagccuagcacacaaaaccccggacgucucguuagcucggauaagaaaagagcucgcccuuccagaaacaguccaauucaacggcgugagaugccgagccaacgaaacccucgaagaaucagagaagaaagaaaaauucgcaugucucccugcguaccacaagaugcgaaaagcacuagacggagucguaaagggcaggaucuccagccuuuccaucucccaaagagacgcagcugcuaccgcacuaucgcuguacaaaaaugaagacacacugagagccaaacucacagaagccgguuuccaagcccccgaaaucgacgcccucgcaggacuaacuggcuucucaaaauuuggacaucuaucacuaaaagccuguagaaaacucaucccccaucucgagcaaggacucaccuacgaccaggcaugcagcgccgccggguacgacuucaaaggccacggcgcaggagagcgugccuucacacuacccgcagcugcuccggaaauggaacaaauaacaagccccguuguaaggcgagcggucgcacaaacaauaaaaguagucaacggcaucaucagagaaauggacgccucacccgcaugggucagaauagaacucgcccgagagcugagcaagaccuucggcgagcggcaagaaauggaccggucaaugcgcgaaaaugcagcccaaaacgaacgccucaugcaggaacuacgcgacaccuuccaccuacugagcccaacgggccaggaccucgucaaauauaggcuauggaaggaacaagacggcgucugcgccuacucgcucagacgccucgacgucgaacgccuguucgaacccggauacgucgacguagaccacauagugcccuauucacucagcuucgacgaccgacgaagcaacaaaguacucguacuaagcagugaaaaccgacagaaaggaaacagacuaccccuacaguaucuccaaggcaagcggagagaagacuucauaguguggaccaacucaagcguccgcgacuaccgcaagcgccaaaaccuucuaagagaaaaacucuccggcgacgaggcagaaggauuucgacaacgcaaucuccaggauacccaacauauggcccgcuuccuauacaacuauaucucagaccaucuagccuuugcacaaucagaagcccucggcaagaaacgcguauucgcagucucaggcgcaguaacaagucaccuacgcaaacgcuggggccugagcaaaguccgagccgacggagaccuucaccacgcacucgacgccgcgguaauagccugcacaaccgacggaaugaucaggagaauaucaggcuacuacggacacaucgaaggcgaauacuugcaagacgcagauggagcuggaucgcagcacgcgaggaccaaagaacgguucccggcaccauggccacgguuucgagacgaauuaaucgugcgacuauccgaacaaccaggcgaacaucugcuagacauaaaccccgaguucuacugcgaauacggcacggaacacauccgcccagucuucguaucaagaaugccacgcaggaaaguuacgggccccggucacaaagaaaccauaaaaggcgccgcagccgccgacgaaggccugcucacagugaggaaagcccuaaccgagcucaaacuagacaaagacggagaaauaaaagacuacuacaugccaucaagcgacacacuccuguacgaagcacuaaaggcacaacucagacgguucggcggggacaguaagaaagccuucgccgagcccuuuuacaaacccaaagcggacgggaccccgggcccccugguaaggaaagucaagaccacagaaaaggccacacucacgguacccguccacggaggcgcagccucaaaugacacgauggugcgcgucgacgucuuccuagugccaggcgacggauacuauuggguccccguguacaccgcggacacccucaagccagagcuaccuaacagagccguaguccagggaaaaccauacagcgaauggaaggaaaugcgcgaggaagacuucauauucagccuauacccaaacgacuuaguauacgucgaacacaaaucaggacuaaaauucacccuccaaaacgccgacuccacgcuagagaaaacccgcacccagacgagcgccuucguauacuucguaggcggguccaucucuacggccaguaucaccauccgaacgcacgacaacgcguacgggauacccagcuuaggaguaaagacauuaaaaacauuccacaaauaccagguagacgugcucggcaacguguuccccguacacaaagaaacccgucaaaaauucagauga

SEQ ID NO: 7361 - RNA, 3255 nt, Artificial Sequence
  Cas9 variant
augaaaaauacccucuaugguaucggccucgauauaggaguagccuccgucggcugggcaguagucgguuuaaacggcaccggagaaccaguaggacuccaucgacucggcguacggaucuucgacaaggcagaacaacccaaaaccggcgaaucccuagcagcgcccaggagaauggcccgcggcaugagaagacggcuccggcgcaaagcauuacgccgcgccgauguauacgcccugcuagagagauccgggcuaucaacccgagaagcgcucgcccagauguuugaagcaggcggucuugaggacaucuacgcccucagaacucgcgcauuagacgaaccagucggcaaagccgaguucagcagaauacuacuccaccucgcacagcggaggggguucaaaucgaacaggagaacagccagugauggagaagacggacggcuacuagcagcgguaaacgaaaaucgccggcguauggcacagggcggcuggcgcacuguaggagaaaugcucuaccgacacgaagcauucgccuuacauaagcgcaacaaagcggacgacuaccucagcacaguaggcagagacaugguagcggaagaagcaagccuuuuauuccaacgccaacgcgaacuaggcugcgcuugggcuacgcccgaacuacaagccgaauaccucucaauccuucuccgacaacggaguuucgacgaagggccgggcggagacagccccuacggagggaaccaagucgagaaaaugguggggaggugcacauucgaaccagacgagcccagagccgcaaaagccgccuacagcuucgaguauuucuccuuacuccagaaaauaaaccauauccgccuagcagagaacggcgaaacccgcccccucacacaaccccaacgccagcaacucuuaucacucgcccacaaaacaccagacaugucacuagcgaggauaagaaaagaacuggcccuccccgagaccguacaauucaacgguguacgauguagagccaacgagacauuagaagaaagcgagaaaaaggaaaaauucgcgugccucccggccuaccacaaaaugcgcaaagcacuaggcgguguaguaaaaggaagaauauccagccuguccaucucgcaacgcgacgccgccgcaacagccuugucacucuacaaaaacgaagacacacuacgagcaaagcugacggaagcaggguuccaggcaccugaaauagacgcccuagcaggccuuacuggauucagcaaauuuggccaccuaucacucaaagcgugccgaaaacuaauaccccaucucgagcagggacuaaccuacgaccaggcuugcagcgcagccggguacgauuucaaaggucacggagccggugaacgagccuucacacuacccgccgccgcacccgaaauggaacagaucacaucacccgugguuagacgggccguugcccaaaccaucaaaguagugaacggaaucauacgagaaauggaugcuagucccgccuggguaagaaucgaguuagcgagagagcuuuccaaaaccuucggggaacgacaggaaauggaccgauccaugagagaaaacgcugccaaaaaugagcgacucaugcaggaacuaagagacacauuccaccuacuaucgccgaccggccaagaucuagucaaguacaggcucuggaaagaacaagacggcgugugcgcauacucacuacaacgccucgacgucgagcaacucuucgaaccgggcuacguagauguugaccacauagucccauacucacucagcuucgacgaccggagaagcaacaaaguauuaguauuauccagcgagaaccgacagaaaggcaaccggcucccacugcaauaccugcaaggcaagcggcgcgaggacuucauagucuggacaaacuccucaguacacgauuaccgaaaacgacaaaaccuccuacgggagaagcucucagacgaugaagccgaaggguucagacaacggaaccuccaagacacccaacacauggcccgcuuccucuacaacuacaucagcgaccaucucgcauuugcacaaagcgaagcccugggaaagaaacgcguauucgcggucuccggcgcagucacaagccaccuccgaaaaagauggggccucucaaaaguaagagcagauggagaccuacaccaugcccuagaugcagcagucguagcuugcaccaccgacggcaugauucgacgaauaucagguuauuacggccacauagagggagaauacuuucaagaugccgacggcgcgggcucacagcacgcgcggacaaaagaacgcuucccugcacccuggccccgcuuccgcgacgaacugaucguccggcuauccgaacaacccggagaaccccuacuagauauaaaccccgcuuucuacugcgaauauggaacugaacacaucaggcccgucuucguauccaggaugcccaggcgcaaagucacaggcccaagccacaaggaaaccguaaagggcgcagcagcagcggacgaaggccugcucacaguucgcaaagcgcugacagaacucaaacucgacaaggacggcgaaaucaaggauuacuacaugccaagcagcgacacccuccucuacgaagcauuaaaagcacaacugcgacgcuucgguggcgacggcaagaaagcauucgccgagccauucuacaaacccaaagccgacggaacccccggcccccucgucagaaaaguaaaaacaacagaaaaggccacgcuaacaguccccguccauggcggcgccgccaguaacgacacaauggugcgaauagacguauucuucaugcccggagauggauauuacugggucccccucuacgucgcagacacacucaaacccgaacuacccaaucgcgccgugguagcccacaaacccuacagugaauggcaggagaugagagaagaggacuucguauucucacucuacccaaaugacuugguguacguagagcacaaaagcgaacuaaaguucaccguucaaaaugccgacucgaccuuggagaaaacccgcacacaagccucagcauucgucuacuucgucagcggcgguaucucaggcggaaccaucacaguaagaacccacgacaacagcuacgguauccccagccucggccucaaaacccuaaagucacuaugcaaauaccaaguagacgugcucggaaacguauucccagugcacaaagaaacgagacaaaaauuccgcuga

SEQ ID NO: 7362 - RNA, 3255 nt, Artificial Sequence
  Cas9 variant
augaaaaacacucuuuacggaaucggccuggacauaggcguagccuccgucggcugggcaguagucggccucaacgggaccggggaacccguaggacuucaccgccuaggcguacgaaucuucgacaaggccgaacaacccaagaccggagaauccuuggcagccccacggcgaauggcaagaggcaugcgacgucgacugcgccggaaagcccucagacgagccgacguauaugcacuccuagaacggagcggacuaagcacccgagaagaacuagcccaaauguucgaagccggaggacucgaagauaucuacgcacuccgcacucgcgcccuagacgaacccgucggcaaggccgaguucucccgcauccuccuacaccuggcacaacgcagaggguucaaaagcaaccgccgcacggccucugacggugaagacggcagacuccucgcugcagucaacgaaaaucgucgccguauggcacaaggcggcuggcgaacagucggggaaaugcucuaccggcacgaagccuucgcucugcacaaacgcaacaaggcagacgacuaucuaucaaccgucggccgagacaugguagcugaagaggccagcauauuauuugaacggcaacgugccaugggcugcagcugggcagcaccagaacugcaagccgaauaccuaucaauacucuuacgacaacguagcuucgaugaaggacccggcggcaacagccccuacggaggcaaccaaguugagaaaaugguuggccgaugcacguucgaacccgacgagccccgagcagcuaaagcagccuacagcuucgaauacuuuucgcuccugcaaaaacucaaccacauccgacuggcagagaacggcgaaacacgaccucucacccaaccacaaagacaacaacuccuuucccuggcccacaaaacccccgauaucagccucgcccgaaucagaaaagaacuugcucuccccgagacagugcaauucaacggcguaagaugcagagccaacgagacccuggaggaaagugagaaaaaggaaaaauucgccugccucccagccuaccacaaaaugcggaaggcccuagauggaguaguaaaaggucgaauauccucccuguccaucucccaaagagacgccgcagccacggcucuuagucuuuacaagaacgaagacacgcuucgagccaaacucacagaagcugguuuucaagccccggaaaucgacgcccucgccggacuuacaggcuucagcaaguucggccaucucucccucaaggcaugucgcaaacucaucccacaccucgaacagggguuaaccuaugaccaggcaugcacagcagcaggguacgacuucaaaggucauggcgccggcgagcgagcauucacgcucccagcagccgcccccgaaauggagcaaaucaccucaccugucguccgccgcgcgguugcacagacuaucaaaguaguaaacggaaucauccgcgaaauggaugccucgcccgcaugggucagaaucgaacucgcccgcgagcucagcaagacauucggagagcgccaagaaauggaccgaucuaugcgcgagaacgcggcacagaacgagcgccucaugcaagaacuccgagacaccuuccaccuacucucacccacaggacaagaccugguaaaguacaggcuauggaaagaacaagacggcgucugcgcguacagccuccgccgacuggacguagaacgccucuuugaacccggauacgucgacgucgaccacauagucccauacucccucucauucgacgaccgacgcagcaacaaaguccugguacuguccucggaaaacagacaaaaaggcaaccgacuaccacuacaauaccugcaagguaaacgacgagaggacuucaucgucuggacgaacagcucaguacacgauuaucgcaaacgacaaaaucuacuuagagaaaagcucucaggcgacgaagcagaaggauuccgccaacgaaaccuccaagacacacaacacauggcccgcuuccucuauaacuacaucagcgaccaccuagcauucgcgcaaucagaggcgcucggcaaaaagagaguauuugcuguauccggagcagucacaucacaccuaaggaaacgauggggccucagcaaaguccgcgcagauggcgaccuccaccacgcacucgacgccgccgucgucgccugcacaacagacggcaugauacgccgcauuucaggcuacuacggucacaucgaaggggaguaccuacaagacgcugacggggcaggaucccagcacgcaagaacaaaggagagguuucccgcccccuggcccagauuccgagacgaacuaaucguccgacucuccgaacaacccgcggaaccacuauuagacauaaacccagaguucuacugcgaguacggaacagaacacauucgaccagucuucguauccagaaugccccgacgcaaagucacaggccccggacacaaagaaacaauaaaaggcgcggcggccgccgacgaaggucuccucacgguacggaaagcccuaacggaacuaaaacucgauaaagacggagaaauaaaagacuacuacaugccauccucagacacacuacuuuacgaagcccuaaaagcacaacuaaggcgauucggaggggacggcaaaaaggccuuugccgaacccuucuacaaaccgaaagccgacggcacacccggcccgcuaguucgcaaggucaagaccaccgaaaaagcgacacuaaccgucccaguccacggcggagccgcaucaaacgacaccauggugcgagucgacguuuuucuagucccaggagacggcuacuacuggguccccguauacaccgcagauacccuuaagccggaacucccgaacagggcugucguccaagggaaacccuauucagaauggaaagaaaugcgagaagaagacuucauauucagccuauaccccaacgaucuaguauacgucgaacacaaaucugggcuuaaauucacguugcagaaugcagacucaacccuagagaaaaccaggacucaaacaucagcauucgccuacuucgucucuggcucgauaagcaccgccucaaucacaauccgaacccacgacaacgcguacggcauccccucacucggagucaagacacucaaaacauuccauaaauaucaaguagacguccuaggaaacgucuucccaguacacaaagaaacacgacagaaauuuagauga

SEQ ID NO: 7363 - RNA, 3255 nt, Artificial Sequence
  Cas9 variant
augagacuuggccuggauaucgggacgaacagcaucggauggugguuauauggaacggaaggagggcgaauaacagaagucgucgacgggggaguaagaauauucucagacgggcgcgauccgcagagcaaggccagccuagccgucgaccgcagagcagcgaggagccaacgacgaaggagggauagauaccucagacgcaaagcagcacucaugaagagaauggcgcaaguaggauugaugccggcugacccagccgaggcaaaagugcuagagguacuaaacccguacgaacuaagggcuucaggcuuagacggaccccuaccacuaacccacuucgggcgcgcccucuuccaccugaaccaacgcagaggguuuaaaagcaaccggaaaacagaucguggcgauaacgaaucagguaaaauaaaagacgcuacagccagacuagaccaggcgaugauggcgaagggagcgagaacguacggcgaguuccuccacaugaggagagcagccgcgcuggacccaaaaagcguaccaucagucagaacaagacugacggucgcaaggagggacgacgccgaaaaagaagaagcaggauacgacuucuacccugacaggaaacaccuaagcgaagaguucgauaagcuaugggcagcccaagccaggcacgcgccagacguauuaacagaagaccuacgggaugaaaucgcgacaauaauauuccaccaacgaccccuaaaaacgccagaaguagggcucugccuauuuaccgggcaacacggcguaccagaacgcgacaaaagaaucccaagugcgcacccccucaaccaacgacgaauccucauggaaacagucaacaaccuaaagguggcagcgcagggcgaaccaagccgaccgcuaaccagagaagaacgagaucagauuguccaugcccuggacaacaagaaacacacgaaaucacuauccggcaugacgaugaaacugaaagcacugggaaaaguaauaaaacuacggccugaacagggguucacacucgaaacugcaaacagagacgccaucgcaugcgacccagugagagcgagccugucucacccagaccgcuucggagcacgauggagcacccucgaaagcgcagggcagugggacguaguacaacgaaucagggccgugcaaucagacgcggaacacgcagaccuugugggcuggcugauggacguacacggguuagaccgagaccaugcagaagaaacugcaaacgcuccacugccagagggauauggcaggcuaggacucacggccacgacgcgcauacuagcagcccuggaggcagauguucuaaacuacucggccgcuguagcugcaugcggguggcaccacagcgacgggcgaacaggggaaguccuggagucacucccuuacuauggagagauucucgaaagacacgugauaccgggcaccggagaccccaacgacgacgacgucaaaagguacggaagaauaacuaacccgacagugcacaucggacugaaucagcuaaggaggcucgucaacaggaucaucaccguguacggacgcccggacgagauaguaguagagcuagcgcgcgaucucaaacucucagaagaccaaaagaaagacguacaacgcgacaucaagaaaaacacagaggccgccauuaggcgagggaagaaacuagaagagauggguguacccaacaccggagcgaaccggaugguacuccgccugugggaggaccugggcgaugaugugaugacacgaaacugccccuacacuggcaaacgaauaucagcaggcaugcuguucgacggcagcugcgacguagaccacauccuaccauacagcagaacacucgacgacagcuucgccaacagaacacugugccucaaagaagcgaauagacagaaaacggacaaaacaccuugggaagccuggggagaaacagagcaaugggaggcgauagcugcuaaccugaaaaaccucccagcgaauaaagcauggagguucgcaccagacgcaauggaaagguucgaaggggaaaaagauuucucagcacgagcccuagcagacacccaauaccuaucgcggauugcaagggcguaccuggacgcacucuacgacggugacgacggcaaaucccacgucugggugguaccaggccgacugaccgaaaugcugcgaaggcacuggggacuaaacggagucgcggcacugacagacagcgacaaacagacagugaaagcgaaaaacaggacagaccauagacaucacgcaaucgacgcagccgugguagcagcaaccgauagagggcucauaaaaagaauagcggacauggcgaagcgagacgaguuuaacggagccgaggaagucgcacgaagcauaccaccgcccugggaaggauucagagacgacgugucagcacaaguaacacgaauaauaguaagccaccgugcagaccacggcagaauagaccccgccgcacgaaaauccggacgagacucaaccucaggccaacuccacaacgauacagcauauggcauaggcagagacggaaccgucgugagcagaaaaccccucgcaucccuuagcccaaacgacauaguggucaccaaacguggagccaacauaagagacguagaccuacagaaacaccuagcgcguguuacccacgggcuagacggaaaggcuuucgaagccgcacuccuggcauucgccgccagcccaauccuaccagacaacacggacaaccccuacuucggacuccggcgcgugagacucgaagaaacgcuacaagaaagcgcgagaguagagguagcagaccaagagggaaggcccuacaaagcauacaaaggcgacagcaaccacugcuacgaaauauggugccuacccgacggaaagauuaaaccccaagugguaacaacauacgaagcacaccagucaggcgcagagaaaaagccacacccagcagcaaaaagacucaugcgaauauucaaacgggacauggucaugcucgaacgcgacggggaaacgaucaucggauacguacagaaaaugaaacaaaacggaagcaucuucgucgccccacacacagaagcaaacgcagacgcccgagacagagacccgaaggacgacuucaaacucauccagcucggcgccgguagcuuagugaaagcaaaagccagaagagugauuguagacgaaaugggccgacuccgcgacccaggcccgccacucuga

SEQ ID NO: 7364 - RNA, 3258 nt, Artificial Sequence
  Cas9 variant
auggacaagggcaccaacucgaucggaugggccgcgcuaaggcuagacgaacaaggagaacccguagggauaauugaggcuggcgugcgcauauacgccgacgggagagaaccaaaaucagggacuucgcucgccgagggccgacgaauagcacgaggaaugucgcgccgcagagaucguuauaaacgacgccgacgaacgguacuaaacacccugacggaguucggacucaugccggccaccaaggccgcaagaaaggcccucguggccgaaacaaacgaccgaagguucggcgaaguagccuccaacguauaugcacuccgagcaagagcccuagaugaaaagcucccacuauaucaacuagggagagcacuguuccaccuaaaccaacgccgagguuucaaaucgaaccgaaagacggauaagagagacaacgaccagggcaaaaucgccucagcaaucucgagacuaggacgaaaacuugacgaagcaggagcgcgcacccucggugaguuccuccacaagcaacaugcagccgggaaauggguaagggugcggcccagucgaguaccgggcgaagacgacaaggaagaagacggauacggauucuacccagaaaggucauuccucgaaagagaguucgcggccauaugggaagcgcaggccgccuucuaccccgaacugcuaacagaggaaagaagggaccaucugcacuggguaauguucuuccagagaccacuaaaaagaccaaccgucggcaaaugcagcuuccaccccgacgaagaccgauuacccaaggcacacccccuauuccaagaauuuagacuaauuaaagagcucaaugagcuagaaguggugcacagaggagacagacgcgaaaaacuuaccccagaucagagagaccgacucuucaaucaacucagaacacaaagauccucggcauucaccgcacucaggaaaacaaucaaagccccaaccggcacgagguucaacaaagaaucggacgcccgcgacaagcugaaaggcgacgaaguugccgcggaaaugagccacaaagaccgauuuggccaagccuggauaggaaugccgcuagcagaaagaugggccguaguagccaugcuucucgacacggaagacccccuagaagugaaggcguggcucgaagaacgguacggcuucgcugccgaccgaaucgacgccauagccgcagccaaacuaccaacgggauacggacgccuaggcgaaacagcacuccgagacaugcucgacgaacuacgaaacggcaccgucaaagaugacgcgggacgggacgucguccucacggaacgacaggccauggacaacauauggggagacaaccccgcacuccaacgcgcaguuacagacgcaagagaguuacccccuuaccaagaaguucuaggccgccggauaccucccggcaccggcaaacccgcagacccauaugacguccagaaggggcgacucacaaauccaacaguacacaucggucuaaaccagcugaaaaggauaguuaacguacuaaugagacgccacgggcgcccagaacagauagcacucgaacucgcacgcgaccuaaaacuuaaugaagaacaaaaggcagagaaaaaucgcgaaauagcaagaaacaccaaagccgccgaagccagagggaagaaacucgaagaacuaggccacgcgaacaacggguacaacagggugcuccucaaguuaugggaagaccucaaccugaaacaaccggaaaacagagaaugcauauacugcgguaaggcgauaggcauaggaacacuucugucuaaccaagucgacaucgaccacauccuaccauggucaaagacccuagaugauucacaggccaacagaaucgucugccauguagaaugcaacagacagaagggcaaccacgcgccagcagaagucccccaauggcacgaccgauacgaugacauacuagcacgcgcagaacgccuacccagaaacaaagccuggagauucggacgggaagcgaugaagaaauucaaagacgacgaauccuuccuagccagacagcuaacugacacccaauaucucagccggcuagcacacgaauaccugggcgcccuauaccccgacgaggaaccggacgaauggggcggaccggcaagacgaaaucacguaagagugauaccaggaagaaugacagaaaugcuacgccgccaauggggccucaacgccauaauaucggaccacaaccagaaaaacagaaacgaucaccgccaccacgcaauagacgcuaucguaguggguguaacaacaaggagacuccuccaaagaaucgcgaccgucgcaggcggcagggaggcccuagcccucgaagaaaccauaggaaaaaucgaaccacccuggcccggauucuacgacgacgugaaagccgcaauagaccguaucguagugucccauaaacccgaccacggaucacuacccaaaccaggaaagcccgguagaacggcuggccaacuccacaacgacacagcauacgguuucacaggagaagcgagaaacggcgugccaaucaugguccacagggugccguucgcgucgcuaaccgaaaaggacaucccgagcauacgagacagacagcuagccgaugcguuguacgcugcaauaagcggaauuagcggaaaagcggaacucgcagccgcacuagcccgauuuagugaguccggaccguacaaaggcauacgccacguuagggucguagaacccguaucggugauagcgauaaaagaccaagcaggaaaggccuacaaaggauacaagggagacgcaaacuaccgauacgacguaugggagcugccaaacgggaaauggacacacgaaguaguaucaauguucaacgcacaccgacccgacuggcaaagcgaaauaagaucgaagaaucccgccgcaagaaaaguacuaucccugcaucaaaacgauaugguagccuacgagcacccacaagacggauauaccauuggacgcgucguuaaauucagcgccggaggccaaauggcacuagccggaaaucgcgaaggaggagcccucaaguccagagacgcagacccagaagaccgauuccgauacuucuacaaaucaggaggagcgaugcgcgacguccaacucagacaagugcggguggacgaaacagggagaguguucgaucccggaccacaggauagagagucacggaaugcccgaaagcaaaacgacgcaggguga

SEQ ID NO: 7365 - RNA, 3264 nt, Artificial Sequence
  Cas9 variant
augcgcuacaaaaucggccucgacaucgggauaacauccguggggugggccgucaugaaccuugacauaccccgcaucgaagaucucggcguccgcaucuucgacagagcagaaaacccccagacaggcgaaucgcucgcccucccuagacgauuagcacgguccgcccgccgccgacuacgccgacgaaaacaucgucucgaacgcauacgccgccucguaauacgagaagguauacugacaaaagaagaacuggacaaacuguucgaagaaaagcacgaaaucgacgucuggcaacuucgaguagaagcauuagaccgcaaacuaaauaacgacgaauuagcccgcguccuccuccaccucgcaaaaagacgaggcuucaaauccaaccguaaaucagaacgaucaaauaaagagaacaguaccaugcucaaacacauagaagaaaaccgcgccauccuaucgucauaccggacaguaggcgaaaugaucgucaaggacccaaaauucgcacugcacaaaagaaacaagggcgaaaacuacacaaacacgaucgcucgcgaugaccuagaacgcgaaaucagacucauauucaguaaacaacgcgaguucggaaacaugagcugcacagaggaguucgaaaaugaauacauaaccaucugggcaagccaacgccccguggcgagcaaagaugacaucgagaagaaagucggcuucugcacauucgagccaaaagaaaaacgcgcgcccaaagccacauacacauuccagucuuucauagcaugggaacacaucaacaaauuacgccugauaucaccgucgggggcacguggcuuaacugacgaggaacgacgccugcuguaugaacaggcuuuccagaaaaacaaaaucaccuaccacgacauccgcacgcuacuacaucugccagacgacacguacuucaaaggaaucgucuacgacagaggcgaaucccgcaaacaaaaugaaaacauacgcuuucucgaacuagacgcguaccaccaaaucaggaaggcaguugacaaagucuacggcaaggguaaauccaguagcuuccuacccaucgacuucgacacauuuggauacgcccuaacccucuucaaagacgacgccgacauacacuccuaccuacgaaacgaguacgaacaaaacggcaaacgaaugccgaaccucgccaacaaaguauacgacaacgaacuuaucgaggaacuacucaaccucuccuucacuaaauucgggcaccuuucacucaaagcacuacgaucaauccugccuuacauggaacagggagaagucuacuccuccgccugcgagagagcaggauacacauucaccgguccgaagaagaaacagaaaaccaugcuacuuccaaacaucccacccauagccaacccgguagugaugcgcgcacuaacgcaagcgcgcaaagucgucaacgcgaucaucaagaaauauggcucccccgucuccauacacauagagcucgcccgagaccugagccaaacguucgacgaacgccgcaaaaccaaaaaggaacaagacgaaaaucggaagaaaaacgagacagcgaucagacaacucauggaauacggucuaacacucaauccaacaggacacgauauugucaaauucaaacucuggucagagcagaacggccgcugcgccuacagucugcaaccaaucgaaaucgagagacugcuggaaccaggcuacgucgaagucgaccacgucauacccuacagccgcucccuagacgauucauacaccaacaaaguacucguacuuacacgugaaaaucgcgagaagggcaaccguauccccgcggaguaccucgggguaggcacggagagauggcaacaauucgagaccuucguacuuaccaacaaacaauucuccaaaaagaaaagggauagacuacuucggcuacacuaugaugaaaacgaagaaacagaguucaaaaaccggaaccucaacgacacgcgguacaucucccgcuucuucgcaaauuucauccgagaacaccucaaauucgcggaaagugacgacaaacaaaaaguguacaccgucaacggaagaguaacagcucaucucagaagccgcugggaguucaacaaaaaccgagaagaaucagaccugcaccacgccgucgacgcugucauagucgcaugcacgaccccguccgacaucgccaaaguaacagccuucuaccaacgccgagagcaaaacaaagaacucgcaaagaaaaaggaaccacacuucccccaaccguggccucacuucgccgacgaauuacgagcaagacucuccaaacaccccaaagagagcaucaaagcccugaaccuugguaauuaugacgaccagaagcucgagagccuacaacccguguucguaagccgaaugccaaaacgcucaguaacgggcgcagcccaccaagaaacacuccgacgguacguaggcauagacgaaagguccggcaagauacaaaccgucgucaaaacaaaacucuccgagauaaaacuggacgccagcggccacuuccccauguacggaaaagaauccgacccccgaaccuacgaagcaauacgccagcgcuuacucgagcacaacaacgaccccaagaaagccuuccaagaaccacuuuacaaaccaaagaaaaacggcgaacccggcccaguuauccgaaccgucaaaaucauagacaccaaaaaccaagucaucccccugaacgauggcaaaacaguggccuauaacucuaacauagucagagucgacguauuugaaaaagacggaaaauauuacugcguccccgucuacaccauggacauaaugaaaggcauccuaccaaacaaggcaauagaaccaaacaaaccauauucggaauggaaagagaugaccgaagacuacaccuuccgcuucucacuauauccgaacgaccugauacgcauagagcugccaagagagaaaaccgucaaaacagccgcaggagaagaaauaaacguuaaagacgucuuuguuuacuacaaaacaaucgauuccgccaacggagggcucgaacuaaucagccaugaccacagauucagccuccgcggcguaggauccagaacacuaaagcgauucgaaaaguaccaagucgacguacucggcaacaucuauaagguacgcggagaaaagcgcguaggucuagccucgagcgcacacuccaaaccagggaagaccauacggcccuuacaaagcacucgagauuga

SEQ ID NO: 7366 - RNA, 3264 nt, Artificial Sequence
  Cas9 variant
augcugcguaugaaauacgccaucggacucgacauuggcaucgccucgguaggcuacgcuguccucgcgcucgaucacgaagaaaacccguggggcaucaucaggcucggaucgcggaucuucgacgucgcagaaaauccaaaggacggcgccagccuagcauuaccacggcgagaagcgcgcucaguccgacggcgccucagacgucaccaccaccgccuggaacgcauuaaaaaccugcuaauaaacaccgaguucauaacaaaggacgaacugcuccaccucuacgacggaaaccuuagcgacguuuacgaacuacgcguaaaagcucucgacuacucagucaccaaugcggaacucacuaggauacuacuucauuuagcucaacgcagaggcuucaaaaguaaccguaagagcgacgccaacgacaaggaagccgggcaacuccucgaagcaguguccgccaacgccaaacguaugcaagagaaucauuaccgcaccguaggggaaauguucuacaaagacgaccuauucagcaaguacaaacgcaacaaagggggcaccuaucuaacaaccguacaccgagacaugauugccgcggaagcccgcaccauucuagaaaaacaguuugcccucggcaacaacauaugcacccaagacuucaucgacaaauaccucuccauccuacuaucccaacgccaguucgacgaaggcccgggagagccuucccccuacgccggaaaucaaaucgcaaacaugauaggaaagugcacauucgagccuaacgaauacagggcggcaaaggccucguacucuuucgaacgauucaaccugcuacaaaaggucaaccaccuccgucuacuccuugagggcaaguccauagcacuugacaacgaacaaagaaagaaaaucauagcccucgcacaugacaaagcagaucuccgcuacagccacauccgcaaagcgcuaggccucgacgaaaaaguccucuucaauacaaucacuuacaacgacgacguauccguuauagagaaaaagacaaaguucaacuuccuccaagcauaccaccagaucaagaaaguccuggccgaagauaugcaaaaacuaacuacggagcagcucgauaacaucggccaaauacucucaaccuauaaaucggauaacaaacgaaccgaagaacugagcgcccuaggacuagagaagaaaauaauagacgcacuccuuggcauaaacgggcucuccaaguucgcccaccugucccuaaaagcacuccgaaaaaucaaccccuacuuagaagaaggcaaaauauacaaugaagcgugcacggccgcaggcuacgacuucaaggcacacgccaacacacagaaaacagaacuccugccagccuacaaggaagaaauggacgacaucaccucacccguagccaggcgcgccaucgcccaaagcauaaagguaaucaacgccaucauucgcgaacaaaagggauccccacucuacauuaacauagagcuagcccgggaaauggccaaaggcuucgacgaacgaacccaaauagacaaagccaacaaagagaaccaagcaaagaacgaacguauaauggaacgaauccgcacugaguuccacaaagcuaaccccacaggaauggaccuaauaaaacugaaauuaugggaagaacaagacggacguagccccuauucucaaaaagcaauauccaucaaccgucuguucgaacccggcuaugucgacaucgaccacauaguccccuacucuaucagcuucgacgauucguucaaaaacaaaguacuuguauucagcgacgaaaaucgagacaaaggcaacaggcuccccaucgcauaccuccaauccaaauucggagcuaaagcagccgaaaacuucaugauauggguccaauccaacaucaaagauuacaagaaaagacaaaaacuacuaaaaagggaaaucacagaagaagacauaaacaaauuuaaagagcguaaccuccaagacacuaaaaccaucucccgcuuccuauauaacuacauaaacgacuaucuacuguuugcacccucggacacgggcaaaaagaaacgcgucaccgccgucaacggaacaauuaccgccuaccuaagaaaacgcugggguauaaacaaaauacgggcaaacggagacaaacaccacgcaguggaugccguagugaucgccugcacaaccgacaagaugauaaaagaccuuuccuccuucagucgauaucacgagcucgaauacacccacacggacaccgaauccuuccuuguuaauagccuaaccggggaaaucuuaaagcgguucccguaucccugggaagacuuccgacccgaacuuauggcacgucucagcgacaaccccgcagacgcccuacgcaaacucaaccucaucuucuaccacggaaucgaccucucaacaaucaagcccaucuucgucuccagaaugccacggcacaaagucacgggagcugcccacaaagccacgaucaaauccgcaagaugucuugacaacggcaucgucaucugcaaaacaucccuccaaaaccucaagcuagacaaagaaggagaaauagccaacuacuacgcacccgagagcgacaccauccuauacaacgcccuaaaggaacgcuuacgguccuacgacaacaagccggcaaaagcguucgccgaacccuucuacaaaccgaaagccgacggaacucccggaccccucgucaagaaaguaaagguauaugagaagaguacguugaacguagcgguacagcaaaacacagccguagcggacaaugacagcauggucagaguagacgucuuucacguaaaaggcaacggauacuaccucguccccaucuauaucgcagacacccucaaaaaggaacuccccaacaaggccauagucgcuuacaagccauacgcagacuggccggugauggacgacucuaacuucaucuucucacuguaucccaacgaccucaucaaauucgagcacaaaaauuccguuaaauucgccaaagucaacaaagaaucaacacuaaacgacuucuacuccaccaagagugagaucguauacuucaaagggugcaacaucaauaccggggccauaaccaucauaaaucaugaaaacacuuacgucguauccucccucggcgucaaaacgcuccccucacucgagaaauaccaagccgacguccucggcaacuacaccaagguaaagaaagaaguacgcaaacccuuccgauga

SEQ ID NO: 7367 - RNA, 3264 nt, Artificial Sequence
  Cas9 variant
augcgcuacaaaaucggacucgacauaggcauaaccaguguaggcugggccgucaucaaccuggacauuccacgaauagaagaccuaggcguacgaauauucgaccgcgcagaaaacccacaaacuggugaaagccuagcgcuaccccggcguuuggcccgcucagcccgccgacgccuucggcgccgcaaacaccgccuugaacgaauacgucgcuuaauaauccgcgaaggaauccuaacaaaggaggaacuagacaaacucuucgaagagaaacacgaaaucgacgucuggcaacuacgaguagaggcccucgacaggaaacuaaacaacgacgaacucgcaagagugcuucugcaccucgcaaagcgccgaggcuucaaaucaaaccgaaaauccgaacgcagcaacaaggaaaacuccacaaugcuaaaacauauagaagaaaacagggcuauccuaucuuccuaccgaaccgugggcgaaaugaucgucaaagacccgaaauucgcccuccacaagcguaacaagggagagaacuacaccaacacaauagcgcgcgacgaccuagaacgcgagauacggcuaaucuucagcaaacaacgagaguucggcaacaugagcugcacagaagaauuugagaaugaauacaucgcgaucugggcgucacagcgccccgucgcuagcaaagacgacauagagaagaaagucggcuucugcacauucgaaccgaaggagaagagagcaccgaaagccaccuacaccuuccagagcuucaucgccugggaacacauaaauaaacuccgacucaucagcccauccggaacucgcggacuuacugaugaagaacgucgucuccucuacgagcaagcguuccagaaaaacaaaauaacuuaccaugacauacgcacccuccuccaccucccagacgauaccuacuucaaagggauaguguacgaccgcggagaauccaggaaacagaacgaaaacauacguuuccuugaacuugacgccuaccaccagauaagaaaagcagucgacaaaguauauggaaaaggaaaaagcagcucauuccucccuaucgacuucgacaccuucggcuacgcacucacacucuucaaagacgacgcggacauacgauccuaccucagaaaugaauacgaacaaaacggcaaacguaugcccaaccucgccaacaaagucuacgacaacgagcucaucgaagaacuccucaaccuuuccuucacaaaauucggccaccuaagccucaaagcccuuagguccauccucccauacauggaacaaggugaggucuacagcucugcaugcgaaagagcaggauacaccuucacaggacccaaaaagaagcagaaaacuaugcuacuccccaacauacccccgaucgcaaauccggucgucaugagagcacugacccaagcgcguaaagugguaaacgcaaucaucaagaaauacggcagccccguaagcauccacaucgaguuagcgcgggacuuaagccaaacguuugacgaacgaagaaaaaccaagaaagaacaagacgagaaccgaaagaaaaacgaaacggcaauacgacagcucauggaauacggacugacccugaaccccaccggucacgacauaguaaaauucaaacucuggucagaacaaaacggccgaugcgcauacucccuccaaccaauugaaaucgaacgacuccuagaacccggauacaccgaagucgaccacgucauaccguacagccggagucuugacgacucauacaccaauaaaguacuuguacuaacuaaagaaaaccgggagaaaggaaaucgcauccccgccgaauaccugggcgugggcaccgaacgguggcaacaauucgaaaccuuuguacucaccaacaaacaauucucaaagaagaaaagagaccgccugcuccgccuccacuacgacgagaacgaagaaacagaguuuaaaaacaggaaccuaaacgauacaagauacaucucccgguucuucgcgaauuucauacgugagcaccuaaaauucgcagaaucagaugauaaacagaaaguauacacaguaaacggccgcguaaccgcccaccuccgcucaaggugggaguucaacaaaaaccgggaagaaagcgaccugcaccacgcagucgacgccguuaucguagccugcacaacaccaagcgacauagccaaagugaccgccuucuaccagcgccgagaacaaaacaaagaacuggccaagaaaaccgaaccacacuucccccagcccuggccccacuuugccgacgaacuccgcgcgcgccuuagcaaacacccgaaagaaaguauaaaggcgcugaaccuaggcaacuaugacgaccaaaaacucgaaucacuacaacccguauucguaagucgcaugcccaagcgauccguaaccggggcagcacaccaagaaacacuacggcgcuacguaggcaucgacgaacgcagcggcaaaauccaaacagucguuaaaacaaaauugucagagaucaaacuagacgcgagcggccacuuuccuauguacgguaaagaauccgauccccgcacauacgaggccauccgacaaagacucuuagaacacaacaacgacccuaaaaaggccuuucaagaaccccuauacaaaccgaagaaaaacggagagcccggccccgucauacgaaccgucaaaauaauagacacaaagaaccaaguuauaccucucaacgacggcaaaaccguggccuacaacuccaacaucguacggguagacguauucgaaaaagacggaaaguacuacugcguccccgucuacaccauggacaucaugaaaggaauccucccaaacaaagccauagaacccaacaaacccuacucggaguggaaggaaaugaccgaagacuacaccuuuagauuuucgcuauaccccaacgaccugauaaggauagaacuaccccgcgaaaagaucaucaagaccgccgguggagaagaaauaaaaauaaaagaccucuucgccuauuauaagacgauccacucuggaaccgccggacuagagcuagucucccacgacugcuccuucucacucucuggcgucggcucacguacccucaagagauucgaaaaauaccagguagacguccuaggcaacauauacaaaguccgaggagaaaagcgcgucggccucgcaucaagcgcccacucgaagacaggcgaaacaauacgcccccuccaaagcacacgggacuga

SEQ ID NO: 7368 - RNA, 3264 nt, Artificial Sequence
  Cas9 variant
augcgguacaaaauaggccucgacaucgggauaacuucagucggaugggcagucaucaaccuagaccuuccacgcauagaggaccuaggcguccgcaucuucgaccgcgcggagaacccacagaccggcgaaagccuagcgcucccacggcggcuugcgagaucagcacgacgccgacuccgacgacgucgacacagacucgaaagaauccgcagacuacucacccgugaaaacguccuuacacaggaagaauuggacaaacuuuucgagaaaaagcacgaaaucgacgucuggcaacuacgcguagaggcacuagaccggaaacuuaacaacgacgagcucgcucgaguccuguuacaccuagccaaacgccgcggauuuaaaagcaacagaaagucagaacgaucuaacaaagagaacagcacaaugcuaaaacacaucgaggaaaaccgcagcauacucaccggcuaucguacaguaggagaaaugaucguucgagacccgaaauucguccuucacaaacggaacaaaggagaaaacuacaccaacaccauagcccgugacgaccucgaacgagaaauucaacuaaucuucgcgcgacaacgcgaguucggaaacaugauauguacggaagcauucgaaaacgaguacaucgccauauggucaucccaacgccccguggcauccaaggacgacauagagaagaaagucggcuucugcaccuuugagcccaaagaaaaacgagcacccaaggcuacguacacauuccaaucauucaucgcaugggaacacauaaacaaacuucggcucgucuccccgagcggcacucgcgaacucaccgacgaagaacggcgccuccucuacgaacaagcguuccagaaaaacaagcucacguaccacgacauaagaacucuccugcaucugccagacgacaccuauuucaaaggcauaguguaugacuggggagaaccacuaaaacagaacgaaaacauccgauuucucgaacucgaugccuaccaccaaaucagaaaaaccguagacaaaguuuaugggcguggcaaguccagcucauuccuacccauagauuucgacaccuucggcuacgcccucacccucuucaaagacgacgcacacauccgcucauaccuaagaaacgaauacgaacagaaugguaagcgcaucgcaaaccuagcaaacaaggucuacgacaacgaacucauagaggagcuacucaaccucagcuucacaaaauucgggcaccuaagccuaaaagcccuccguaacauccuacccuauauggaacagggcgaaguguacagcagcgccugcgaacgcgcaggguacaccuuuaccggccccacuaagaaacagaaaaccguccuacuuccgacaaucccacccaucgcaaaccccgucgucaugcgagcccuaacacaagcccgaaaaguagucaacgcgaucauaaagaaauacggcuccccugugucaauccacauagaacuggcucgcgaccucucucaaacuuucgacgaacgcaagaaaacgaagaaagaacaagaugagaaccgcaaacggaacgaaacagcaauacgacaacuaaucgaauauggacugacacgaaaccccacaggacacgacauaguuaaauucaaacuauggagcgaacagaacggccggugcgcguacucccuccaacccaucgaaauaaaacgccuacucgaacccggcuacguagaagucgaccacguaauacccuacucccgcucccuagacgacagcuacacaaacaaaguccuaguacuaaccaaagaaaaccgggaaaaaggcaaccgaauccccgcggaauaccucggcgucggaacagaacgcuggcagcaauucgagacguucguccucacaaacaaacaauucagcaaaaagaaacgggaccgauuacuacgccuacacuacgacgagaacgaagaagccgaauggaaaaaucguagccuaaacgacacaagauacaucucccguuucuucgccaacuucauacgggaacaccucaaauucgcagacucagacgauaaacaaaaaguguacaccgugaacggaggcguuacggcccaccuacgaagucgcugggauuucaacaaaaaccgcgaagaguccgaucuacaccaugcagucgacgcugcgauaguagccugcaccacucuaagcgacaucgcacgcgucaccgcguucuaccagagaagagaacaggcaaaagaacuggccaagaaaacagaaccccacuucccccaacccuggccgcacuucgccgacgaacugcgcgcacgccucagcaaaaaccccaaagaguccauaaaagcccuaaaccucgguaacuacgacaacgaaaaacuagaaucgcuacaaccaguauucguaucccgcaugccaaaacgauccguaacaggagccgcccaccaagaaacucuaagacgauacaucggaauagaugaacgcagcggcaaaauccagacugucgucaaaaccaaacuauccgagauuaaacucgacgcauccggccacuucccgauguauggcaaagaaucagacccacgcacguaugaagcaauaagacuacgccuacuagaacacaacaacgacccacgcaaagccuuccaagagccccuuuacaaaccgaagaaaaacggggaacuaggacccaucauccgcacagugaaaauaauagacaccaaaaaccaggucauaccacugaacgacggcaaaaccgucgcguauaauagcaacaucgucagagucgacguauucgagaaggacgguaaauacuacugcgugcccguauacaccauggacauaaugaagaaaguccugcccaacaaagcuaucgaaccgaauaagcccuacagcgaguggaaggaaaugaccgaggacuacacauuccgauucucgcuauacccgaacgaccuaauccggaucgaacuacccagagagaaaaccgucaaaacuaccgccggccaugagauuaacauaaaagacgucuucguuuacuacaaaacaauagauucagcgaccggcggccucgaacucaucucccacgauaacagcuuuucgcuucgaggcaucggaagccgaacgcuaaaacgcuucgagaaauaucaggucgacgugcugggcaacauauacaaaguacggggcgaaaaacgcguaggacucgcaagcucugcacaccccgagacacgagagacgaucagaccacuacaaagcacccgagacuga

SEQ ID NO: 7369 - RNA, 3264 nt, Artificial Sequence
  Cas9 variant
augaagaagcugguguuaggccuggacaucggggucgccagcgugggcugggggaucaucgacgccgagaacggcgacguggucgacaccggggugcgccuguucuccagccgggacgcguccgagaacgagagccgccggaccucccgccagagccggcgccucucccggcgcaagaagcaccggcgcgagcggaucaagcagcugcugcucgcccaugacauggacaucugcgacaucgugaacgagaaccccuacgagcugcgcgucaaaggccugaacgagaagcucgaggugagcgagaucuacguggcccugacgcaccuggccaagcggcgcggcgucuccuaccucgacgacgugguggaggagggcgggaccaucaagagcgagcaccugaacaagaacauggaggagaucaaguccgggaagaugccgugcgagauccagcuggagcgguucgagaaguacggccagguccgcgggaugaucgagaucaaccaggacaccgaggagagcuccuuccuagugaacaucuuccggaccagcgacuacauaaaggaggccaagacgauuuuggccacccagcagaaguuucacaagcagaucaccaacgaguucaucgacgaguacauccacaucauggccuccaagcgugacuacuucaucggccccggcaacgagaagucccggaccgacuacgggguguaccgcacgaacggcgacaccugggacaaccuguucgaaauccucauagggaagugcagcgucuuccccgaggagacccgggccgcccgcucauccuacgucgcgcaggaguucaaccugcugaacgacuuaaacaaccugaagaucagcaaccuggagagcggcaagcucuccgcuagccagaagcacgacaucguggagaaggugaagaacuccaagaaguucggcaccaaggaccugcugaaguacaucgccagcgugugcgagugcaaaauagaggacaucgguggcugccgcguggacaagaaucggaagcccaucaugcacacguucgagaacuaccgcaaggugcacaacgcgcucaacgaggccgggguggaccugcggcugucugagaccgacuacgacgaacucaugaagaucaugacccugaacagcgagacccuggagaucaagaagcaaugcaaagagaagcucccgcaacugacggaggauuaccugaacgugugccucguccucaacaagaagggcgcguucuccggguggcacgcccugagccucaaggccaugaagcugaugaugcccgagcuguacggcaccuccaagaaccaaaugcagaucauccacaccaugcagcucggcaaggccuaccugaagccucugaaccagcagaaguaccucaacagcgaggccauacuggaggagaucuacaaccccaucgcggcccgcuccauccggcagaccaucaaggugacgaacgccauccugaagaaguacgggcaccucgacagcgucaucauugagaugccgcgcgacuaccagaccuccgaagacgagcggaagaugaucgagaagaugcagaaggagaacgagaaggagaagaaggccgcccuaaagagagcgcgggaggaguaccccuuccccgacgaggccuuccgcaaccacaaggagcuggccaccaagcugcggcucugguaccagcaggaccaguuuugcguguacagcggccgcaagaucuccguggucgaccuggugcggaaccccaaccaguucgagaucgaccacaucaucccgcagagcgugucccuggacgacagccucaacaacaagguccugugcuucuccgaggagaaccagaagaaaggucagcagacccccuucuacuaucacaagggcaagagcgggaacuggacguacgagcaguacaagcuguucguggagaagcuguucgacaagaagaagaucagcaacaagaagcgcgaguugcuccucuucgaggaggacaucaacaagugggacgugcggcgcggcuucaucgcccggaaucuggucgacacccgcuacgccucccgggugauccugaacagcuaccagcaguacuucggcaaccacgagaugggaaccaaggugaaggucgugcgcggcaaguucaccucccagcuccgcaaaaaguggcggaucuucaaggaccgcaacgagagccacucccaccacgcgaucgacgcccugaucguggccgccacggccaaccugcggcucuggaagaagaacacccugggggucagcgacgagggcaagguguacgacaaggagaccggggagauccugcccuucgagaagcucaccgagagcgaguacaacgagaugaugaacaaggagcccuaccugaacuucaaaacgaagcugcagaacaucgagaccaaggugaaguacagcuaccgcgucuccaagaaggugaaccggaagaucagcgacgccaccaucuacuccacccgcgagcgggacggcaucgacuacaucgugggcaagaucaagaacauuuacgacgucaagacguacaaggaccaguuccucaagcgcuacaagaagaacaaggagcaguuccugauguaccagcacgacccgcagaccuucgccauccuggagaacaucauggccaccuaccaggacgccgagaaccccuuccucgcguacaagaaggaguacggcgucauucggaaauacagcaaaaagggcgggggcucacccgugaccagccugaaguucaucgacaagguccugggccagaagaucgaccucaccgccaagaaccaggccgcccugcccaagaacaagaagguggugcugcaauccaucacgccguaccgcgccgacgucuacuacgacgagaucgacaagcgguaccaccucaucggugugaaguacagccuguucuccuucagcaagcagggcuacgugaucaaccccauugcguaccagaagcugcucgagaaggaacaaauccacagcgagaugaaguucugcuucucccuguaccgcgaggacaucaucgaguuuggggaggaucccgacagccugacccgguaccgcuucugguccaagaacgagagcggcaagaacaaaaucgaggucaagcccaucgagaagccaaacuucgagaagcagaccgugcucaccauuacgaagaagaucaagauucugaacaaguaccagaccgacgugcuggggaacuccuucaaggcccaggaggagaaggacccccggaacaucgaguga

SEQ ID NO: 7370 - RNA, 3264 nt, Artificial Sequence
  Cas9 variant
augagauacaaaauuggucucgacaucggcauuaccuccguagggugggccgucaugaaccucgacaucccgagaaucgaagaccuaggcguaaggauuuucgacagagcggaaaacccccaaaccggcgaaucacuagcccucccccgaagguuagcucggagcgcgcgacguagacuacgaagaaggaagcacagacuagaacgcauccgucgccucguuauacgcgaaggcauccucaccaaagaagaacucgacaaacuuuucgaagagaaacacgaaauagacguauggcagcuccgagucgaggccuuggaccgcaaacuaaacaaugacgagcucgcgcgaguacuacuacaccuagccaaacgccggggauucaaaucgaaccgcaagagcgaacgcuccaacaaagaaaacuccaccaugcucaaacacaucgaggaaaaucgagccauucuaucuucauaucgcacuguuggcgaaaugaucgucaaagaccccaaguucgcgcuccacaaacggaacaaaggcgaaaacuauaccaacacaauagccagagacgaccuggagcgggaaauccgccugauauucuccaaacaacgcgaauuuggcaauaugaguuguacagaagaguucgaaaacgaguacaucacaaucugggccagccaacgcccgguggcgucaaaggacgacauagaaaagaaagugggcuucugcaccuucgaaccgaaagagaaaagagcacccaaagccaccuacaccuuccaguccuucauagcaugggaacacaucaacaagcuccgccucauuagccccagcggugcccgcggccuuaccgacgaagaaagacgacucuuguacgaacaagcauuucagaaaaacaagaucacauaucacgacauacggacgcuauuacauuugccagacgacaccuacuucaaaggcaucgucuaugaccggggagagagccgcaaacaaaacgaaaacauacgauuucuggaacucgaugcauaccaccaaauacguaaggccgucgacaaagucuacggaaaggguaaaaguagcuccuuccugccgaucgacuuugacaccuuuggauacgccuugacccucuucaaagacgacgccgacauccacucguaccuacgaaaugaauacgagcaaaacgggaaacgaaugcccaaccucgccaauaaagucuacgacaacgaacucaucgaagaacuacuaaaccugagcuucacgaaguucggccaucucucccuaaaagcccuccgcagcauccuccccuauauggaacaaggagaagucuacagcagcgcuugugaacgcgcaggauacaccuucacaggacccaaaaagaaacagaaaacgaugcuccucccaaacaucccaccaaucgcaaacccggucgugaugcgcgcacuaacccaagcccgaaaaguagucaacgccaucauaaagaaauacggcuccccagucucaauacacauagaacucgcacgcgacuugucacaaaccuuugacgaacgcagaaaaaccaagaaagaacaagacgaaaaccguaagaaaaacgaaacagcaauccgacaacucauggaguacggacucacccuaaaccccaccggucaugacaucgucaaauucaaacucuggucggagcaaaacgguagaugcgcauacagccuucaacccaucgaaauagaaagacuccucgaaccuggguacgucgaaguggaucacgugauaccguacucgcgcucacucgacgacuccuacacaaacaaaguacucguccucacccgcgaaaaucgagaaaaagggaaccgcaucccagccgaauacuuaggcguaggcaccgaaagauggcagcaauucgaaacauucgugcugaccaacaaacaauucuccaaaaagaaacgcgaccgacuccuaaggcugcacuacgacgaaaacgaagagaccgaguucaaaaaccgaaaccucaaugacacccgcuacaucagcagguucuucgcaaacuucauacgcgagcaccuaaaauucgcagaaagcgacgauaaacaaaaggucuacaccguaaacggccgggucacggcacaucuacgcagccggugggaguucaacaaaaaccgcgaagaaucagaccuacaccacgccgucgaugcagcaaucgucgccuguaccacccccuccgacauagccaaagucacagcguucuaccaaagaagagaacagaacaaagaacuagccaagaaaacggaaccgcacuucccacaacccuggccucacuucgccgacgaacugagggcacgacucagcaaacacccaaaagaaucgaucaaagcacuaaaccucgguaacuaugacgaccaaaaacuggaauccuuacaacccguauucgucagccggaugccgaagcgaagcgucacgggcgccgcgcaccaagaaacccucagacgauacgucgggauagacgaacggucaggcaaaauucagacaguagugaaaacaaagcugucagaaaucaagcuagacgcgagcggacauuuucccauguacggaaaagaaucugacccccgcacauacgaagcaauacgacaacgccuucucgagcacaacaaugaucccaagaaagcguuccaagaaccacucuauaaaccaaagaagaacggagagccuggcccggucauacgcaccguaaaaauaaucgacaccaaaaaccagguaauaccgcucaacgacggcaaaaccguagcauacaauucgaacaucguccgaguagacguguucgaaaaggacggcaaauacuacugcgucccgguauacaccauggacaucaugaaaggaauacuacccaacaaagccauagagcccaacaaacccuacuccgaauggaaagaaaugaccgaggacuacacauucagauuuagucuauacccaaacgaucuaauccgaauagaacuaccccgugagaaaacggucaaaacggcagcaggcgaagaaaucaacgugaaagacgucuucgucuacuacaaaacgaucgacucggcaaacggcgggcuggaacuaaucagccacgaccacagauucucgcucagaggggucggauccagaacacucaaacgcuucgaaaaauaccaagucgauguacugggaaacauauacaaaguaagaggcgagaaacgagugggacuagcaucaagcgcccacucgaagaccggcgagacuguucguccacuacaauccacccgagacuga

SEQ ID NO: 7371 - RNA, 3264 nt, Artificial Sequence
  Cas9 variant
augcgauacaaaaucggccucgacauaggcaucacaucaguagggugggccguuaugaaucuagacauacccagaaucgaagaccugggcgucaggaucuucgacagagccgagaacccccaaacaggagagucccuagcccuaccacgacgucuagcacgcagugcacgacgaaggcuccgucgccgcaaacaccgccuugaacgaauccgacgacucguaauccgagaaggcauccucaccaaagaagaacucgauaagcucuuugaagaaaaacacgaaaucgacguguggcagcuuagaguugaggcacuagaucggaaacuaaacaacgacgaacucgccagaguacugcuccaccuggccaaacgccgcggcuucaagagcaaccggaaauccgaaagaucgaacaaagagaacucaacaaugcuuaaacacaucgaagagaaccgcgcaauacuuuccucguaccgcaccgugggcgaaaugauagucaaagaccccaaguucgcucuacacaaaaggaacaagggcgaaaacuauaccaacacgauagcccgagacgaccuggaacgcgaaaucagacuaauauuuagcaaacaacgagaauuuggaaacaugucgugcacagaagaguucgaaaacgaauauauuacgauuugggcaucacagcgaccgguagcaucgaaggacgacauagaaaagaaagugggcuucugcacuuucgaacccaaagaaaaacgagcaccgaaagcaacguauaccuuccagagcuucauagcuugggagcacaucaacaaacuccgacugauaucucccuccggagccagaggacucaccgacgaagaacgacgacugcucuacgagcaagccuuccagaaaaacaaaaucaccuaccacgacauccgaacccugcuccaucuaccagacgacaccuacuucaaaggaaucgucuacgaccggggugaaucgcgcaaacaaaacgaaaacauccgguuccucgagcuggacgccuaccaucaaauaagaaaagcagucgacaaaguuuauggaaaagggaaaucgucuagcuuccuacccauagauuucgacacauucggcuacgcccucacgcuauucaaggacgacgcagacauccauuccuaccuccgcaacgaguacgaacaaaacggaaagagaaugccaaaccucgccaacaaagucuacgacaacgaacucaucgaagaacuccucaaccucaguuucaccaaauucggacaccucagucucaaagccuuacguagcauccucccauacauggaacaaggagaagucuacagcuccgccugcgaacgcgccggcuacacguucaccggaccuaaaaagaaacagaaaaccaugcucuuacccaacaucccacccaucgccaaccccgucgucaugagagcccucacccaagcccgaaaagucgugaacgcaaucaucaaaaaguacggcuccccagucucgauccacauugaacuagcccgcgaccugagccagacauucgacgaacggcgcaagacaaagaaggaacaagacgaaaacaggaagaaaaacgaaacggccauacgucaacucauggaauacggacugacacuaaaccccacuggacacgacauagugaaauucaaacuauggucagaacagaacgggcgaugcgcauauucgcuccaaccuaucgaaaucgaacgccugcuagaaccaggcuacguugaggucgaucacgucauacccuacucccgcucucuagacgacucauacacaaacaaaguucugguucuaacccgggagaaccgcgaaaaaggcaaccgcaucccggccgaauaccuaggcguuggaacagagcguuggcagcaguucgagacguucgucuuaaccaacaagcaauucucuaagaagaaacgcgaccgacuacucagacuccacuacgaugaaaacgaggaaacagaguucaaaaaccgcaaccucaacgacacacgauacaucuccagauucuucgccaauuuuauaagagaacaccugaaauucgccgaaagcgaugauaaacagaaagucuacaccgucaacggcagggugacagcccaucuccgcagccgcugggaguucaacaaaaaccgagaagaauccgaccuucaccaugccguagacgccgucauagucgccugcaccaccccaagcgacaucgccaaagugacugccuucuaccaacggcgggaacaaaacaaggagcucgccaagaaaacggaaccccacuucccacagcccuggccacacuucgcagacgagcuaagggcccggcucuccaaacaccccaaagagagcauaaaagcccucaaccuaggaaacuacgacgaccaaaaacuugagucgcuccaacccguauucgugagcaggaugcccaaacguucgguaacaggcgcagcccaccaggagaccuuacgacgcuacgugggcaucgacgagcggagcggaaaaauacaaaccgucgucaaaaccaaacuaagcgagauaaaacucgacgcaagcggacacuucccaauguacggcaaggagucagacccgcgaaccuacgaggcaauacgacagaggcuccucgaacacaacaaugacccaaagaaggcauuccaggaaccucuauacaaacccaagaaaaacggagaaccaggccccguuauacgcacaguuaaaaucaucgacaccaaaaaccaggucaucccacuaaaugacggcaagaccgucgcauacaacucaaacaucguacgcguagacgucuucgaaaaagacggaaaauacuacugcguaccgguguacacuauggacaucaugaagggcauacugccaaacaaagcgauagagcccaacaaaccauacuccgaauggaaggaaaugacugaagacuacaccuuuagauuuucacucuacccaaacgaccucauucgcauugaacugccacgcgagaaaacagucaaaacugcagcaggagaagagauuaacgucaaggacguauucguuuacuacaaaacgaucgacucggcaaacggaggccuugagcuaaucucacacgaccacagauucagccuacgaggcgucggaucacggacccuaaaaagauucgagaaauaccaagucgacguccucggaaacauauacaaaguccgcggcgagaaacgcgucggccucgcauccuccgcccacagcaaaccaggaaaaaccauacgcccacuccaauccacacgagacuga

SEQ ID NO: 7372 - RNA, 3264 nt, Artificial Sequence
  Cas9 variant
augcgcuacaagaucggacucgacauaggcaucaccuccgucggcugggccgucauaaaccucgacauaccacgcauagaagaccucggggugcgaauauucgacagagcagagaacccccagaccggagaaagccucgcccucccaagacgccucgcacgaagcgcgagacgccgacuacgccgcagaaaacaucgccuagaacgcauacgcaggcuaauaauccgcgagggcauacucacaaaggaggaacuugacaaacucuucgaagaaaaacacgaaauagacguauggcagcuccgcguggaagcccuggaccgcaaacucaacaacgacgaacuagcucgcguacugcuacauuuagccaaacgccgaggguuuaaaagcaaccgaaaaagcgaacgcagcaacaaagaaaacuccacgaugcucaaacacauagaggagaaccgugcgauccucuccggguaucgaacgguaggggaaaugaucgucaaagaucccaaauucgcccuccacaaacgcaacaaaggcgaaaacuacaccaacacaauagcucgcgacgaucucgaacacgagauccggcuaaucuucagcaagcaacgugaguucggcaacaugucaugcaccgaaaaauucgaaaaugaauacauaaccaucugggccagccagagaccugucgcaagcaaggacgacaucgaaaagaaagucggcuucugcacguucgaaccaaaagagaaacgagcaccgaaagccaccuacacauuucagagcuucauagcaugggaacacaucaacaaacuccgccuaaucuuccccuccggcgcccguggacuuacagacgaggaaagacgccuucuauacgaacaagccuuucagaaaaacaagaucaccuaccacgacauccgcacacuccuacaccuacccgacgacacauacuucaagggcaucguguacgauagaggcgaaagccgcaaacaaaacgagaacaucagauuucucgaacuugacgcuuaccaccaaaucagaaaagcaguagauaaaguguacggcaaaggcaagucuagcucauuccuucccaucgacuucgacacauucgguuacgcccucacacucuucaaggacgacgcagacauccauagcuaccuccgaaacgaauacgaacaaaacggaaaacgcaugccaaaccuagccaacaaggucuacgauaacgagcucaucgaggagcuccucaaccuguccuucacaaaauucggacaccuaucccuaaaagcccucagauccauacuccccuacauggagcaaggcgaggucuauagcuccgccugcgaacgagccggauacaccuuuacaggcccuaaaaagaagcaaaagacaaugcuccuacccaacaucccuccaauagcuaaucccgucgucaugcgggcccuaacccaagccaggaaaguaguaaacgcaaucaucaagaaauacggcuccccaguauccauccacauagaacuagcccgagaucucucccaaaccuucgacgaacgacgcaaaaccaagaaagaacaagacgagaaccgaaagaaaaacgaaaccgcaaucaggcaacucauggaauauggccuaacacucaacccuaccggccacgacaucgucaaauucaaacucugguccgaacaaaacggaaggugcgcauacucccugcaaccaaucgagauagaacgacuccuagaaccaggcuacguagaggucgaccacgugauucccuacagccgcagccuggacgacagcuacacaaacaaaguacucguccugacaagagaaaaccgcgagaaaggcaaucgcauaccagcagaauaccucggagucgggacagaacgcuggcaacaauucgaaaccuucguccuuaccaacaaacaauucagcaaaaagaaacgcgacagacuacuccgacugcacuacgacgaaaacgaagagaccgaauuuaaaaaccgcaacuuaaacgacacuagauacaucagccguuucuucgccaauuucaucagagagcaucucaaauucgccgagagugacgacaaacaaaaaguuuacacagugaacggacgggucacgucccaccuacguucaagaugggacuucaacaaaaaccgagaagaauccgaucugcaccaugcgguagaugcagcgauuguagcuugcacuacaccauccgauauagccaaaguaacggcauucuaccaacgacgcgaacaaaacaaagaacuggccaagaaaaccgaaccacacuucccccaaccguggccgcacuucgccgacgaacuacgagcgcgccucuccaaacacccaaaagagagcaucaaagcccuaaaccucggcaacuacgaugaccaaaaauuggaaucucuccagcccgucuucguaucccgcaugccaaaaagaagcguuaccggggcggcccaccaggagacacucagaagguacaucggcaucgacgaacguagcggcaaaauacaaaccguagugaaaacaaaacuaagcgaaaucaaacuugaugccuccggccauuucccuauguacgggaaggaaagcgauccucgcacguacgaggccauaagacaacgccuacuagaacacaacaaugacccuaagaaagcguuccaggaaccucuuuacaagccgaagaagaauggggaaccaggcccaauuaucagaaccgucaaaaucauagacacgaaaaaccaggucauuccccucaacgaugggaaaacagucgccuacaacucaaauaucguucgaguugacgucuuugaaaaggacggaaaauacuacugcgugccaguguauaccauggauauaaugaagggcauauuaccaaacaaagccauugaacccaacaaaccguacuccgaauggaaagaaaugacugaagacuacacauuucgcuucucccuauauccaaacgaccucauaagaaucgaauuaccgcgggagaaaaccgucaagaccacgaccggcgaagaaaucaacgucaaagacgucuucgucuacuacaaaacuauugauuccgcgaccggagggcucgaacuaaucagccacgacaaccgauucagccugagaggggucggcagccgaacccuuaagcgcuucgaaaaauaccaaguugacguccucggcaacauuuacaagguaagaggggagaaacgcguaggacuggcaucaagcgcccacaguaagacaggggaaacgauacgaccacuccaaucaacacgcgacuga

SEQ ID NO: 7373 - RNA, 3264 nt, Artificial Sequence
  Cas9 variant
augcguuacaaaaucggacuugacaucgggauaaccuccguagggugggccguuauaaaccucgacaucccucgcaucgaagaccugggcguacgaauauucgacagagccgaaaacccccagacgggagaaagccuggcgcucccucgcagacucgcccgaagugccagaagaaggcugagaagacggaaacaucgccucgaaaggauccgccggcugcuaauccgugaaggcgugcuaaccaaagaagaacuggacaagcuauucgaagagaaacaugaaaucgacgucuggcaacuaagggucgaggcucucgaccguaagcuaaacaaugacgagcuagucagaguccugcugcaccuagcaaaacgacgcggcuucaaaagcaaccgacagucagaacgcucgaacaaagaaaacucaacaaugcucaaacacauagaagaaaacagagccauccucagcggcuaccguaccgucggcgaaaugaucguuaaagacccaaaauucgcucuacacaaaagaaacaagggcgaaaacuacaccaacaccauagcaagagacgacuuagaacgcgagauucgccucaucuucuccaaacaacgcgaguucggcaacaugagcuguaccgaagaguucgaaaacgaauacaucgccauaugggcgucccaacgcccugucgcgucaaaggacgacaucgaaaagaaagucggauucugcaccuucgaacccaaagagaaacgagcccccaaagcaacuuacacguuccagucauucauugccugggaacacauaaauaaacuccgucucauauccccaagcgggacgcggggccucaccgacgaagaaaggagacuccucuaugagcaggccuuccagaaaaacaaaauuacauaccacgauaucagaacacuacuccaccuacccgacgacaccuauuucaaaggcauaguauacgacuggggagagagcuuaaagcagaaugaaaacauccgcuuccuagaacuggacgcguaccaucaaauccgcaaagccauagacaaaguguacgguaaaggcaaaucguccucauuccuaccaauagacuucgacaccuucggguacgcccucacacuuuuuaaagacgacgcggacauccgaucuuaucuaagaaacgaguacgaacagaacggcaaacgcaucgccaaccucgcaaacaaagucuacgacaacgaacuuauagaagaacuccugaaccucagcuucaccaaauucggacacuuaucacucaaagcccuacgcaacauccuaccauacauggagcagggagaaguauacucauccgcgugcgagaaagccggcuacacauuuaccggccccaagaaaaagcagaaaacuguccuacucccgaccauaccacccaucgugaaucccgucgucaugcgggcacuuacacaagcacgaaaggucgucaacgcgaucaucaagaaauacggcucucccgugagcauccacaucgaacucgcacgcgaccucagccaaaccuucgacgaaaggagaaaaacaaaacgcgaacaagacgaaaaccgcaaacggaacgagaccgccauacgccaacuaauggaguacggacuaacccugaacccuacaggccucgacauaguaaaauucaaauuauggagcgaacaaaacggacgcugcgccuacucgcuccagcccaucgagauagaaagacuacucgaacccggcuacguagaagucgaccacgucauccccuacucccggucacuggacgacucauacaccaacaaaguccucguacugaccaaggaaaaccgagaaaagggcaaccgcauacccgccgaguaccucggcgucggcacagaacguuggcaacaauucgaaaccuucguacucacaaacaaacaauucagcaagaagaaacgagaccgacuccuacgacugcacuacgacgaaaacgaagaaauggaguucaaaagccguaaccucaacgauacgagguauauaucccgcuucuucgccaauuucauccgagaacaccuaaaauucgcggagagcgaugacaaacaaaagguauacaccgucaacggccgcgucacgucccaccuacgcucacgcugggacuucaacaagaauagggaagaaagcgaucuacaccacgcaguagacgcagcaauaguagccugcaccacacccuccgauaucgcgaaagucacagccuucuaccagcgccgcgagcaaaacaaagaacuggccaagaaaacggaaccccaauucccccaacccuggccacacuucgcggacgaacuucgggcacgacucagcaaacaccccaaagaaagcaucaaagcccuaaaccucggcaacuacgacgaccaaaaacucgagagccuccaacccguauucgucagcagaaugcccaaacgcucagugaccggagcagcacaccaagaaacccuccggcgauacaucgguaucgacgaacggucaggcaaaauccagaccgucgucaaaaccaaacucucggagauaaaacuagacgcgucaggacacuucccgauguacggcaaggagucagacccuagaacauacgaggcaauccgccagcgauuacucgaacacaacaaugaccccaaaaaggccuuccaagagccucucuacaaacccaagaaaaacggggagccaggaccaaucauacgcacagucaaaaucaucgacacuaaaaaccaggucaucccacuaaaugacggaaaaacaguagccuacaacuccaacaucgugcgaauagacgucuucgagaaagacggcaaguacuacugcgucccaguauacacaauggacaucaugaaagggguacucccgaacaaagcaauagaacccaacaaaccauacucugaguggaaagagaugacagaagauuacacauuccgcuucucucucuacccaaacgaccuaauacgcaucgaacucccacgcgagaaaacugucaaaaccgccgcgggcgaagaaauuaacaucaaagacauguucguauauuacaagacaauagacucggccaacgggggccuggaacucaucucucaugacaacucauucucccuccguggcgucgggucccgcacauuaaaacgcuuugaaaaauaccaagucgacguacucggaaacaucuauaaaguacgcggcgaaaaacgggugggccuggcgucaagcgcccacuccaaaacuggcgaaacuauucgcccacuacagucgacgagagacuga

SEQ ID NO: 7374 - RNA, 3267 nt, Artificial Sequence
  Cas9 variant
augccaaaagaguucgacccacucaaacccgccaaauaccgacuagcucucgacaucgguagcaaaagcauuggauucgccauaaucuuccuuaaagaagacgucaacaaacuccugaaacccuacgcaaucguuagaagcggaguccgcauauucggagacgggcgcaccccggcagccccaggccagcucggaucgucgcuggcagcugaaagaagagucaaaagaagcauccgacggcaauaugccagaaagcgaaaacgacuacagcgccuccuacgaaaccucaaggaacuaggcuucuuucccgacgacucaaagcugugcaagagcuucgaggacuuaaacccauaugaacugcgucacaaaggcuuaacuaaagaacuaaaaccccacgaguucgggaggcuacucaugcacauggccaaaaaccgcggauuccaaagcaacagaaaagucgaccuccuggcagacaacauagacucccaagcaaaagcggaaacaagcgccaugaagucagccaucgccacccuacaaagccgccucaacggcgaguucgaaacacuuggcgccuaccucuacgaacgauucaagaaaggagagacgauaaagaguuccaaaacccagaagggccagaaagccgaguacgaguucucaaucagcaggcgcauggucaaacaagaguucgacagacuuugggccgcccaagaacaauucaaccccgaacucuucaacgagcaagcgaagaacacccuaaaagacaccauauucuuucaacggaaccuacuaccacagaagguagggaagugcacguuccuccccgaacacgaacgggcuuccaaagcacuacccuccagccaauacuuccgcauuaucuccgaacucaacaagaucuccuucaccgacgcggagggcuugauccuaccuauaagccuagagcaacgcaacaaacugcucaaaucccuacggaucaaacaaaaacucagcuucgaccgcauaagaacagaacucaaccuagacucgacaguacuaauaaaccuagaacacgccucgaaagauuccauagagggggacaagaccgguuaccuacuauccaagaaagaauacuucggaccagcguggagagaccugucccucgaaacacaggacgcaauagucacggcguuacuaacgcacgaaaacgaagccgagcuagugcaaaagcuaguagacgacuucaacaucgcacaugacgucgcgaaagcacucgccaacgcccgccuggaaagccaauacaugcgacuguccaaagaggcaaucgaaaggcucauccccgaacucgaaaaaggagucgacucccaagauggauacaaagucccagucaaauaccacgaagcgacagaagccgcaggcuucggacaccacagcgcacuacaggaaaacugggcagacuucccaacgcucgaccucaaacaacuccacuccgacgauaacgacaaauacaccguagccgaacucccccuuccuuacuacgggaaagugaucacccgacaaguagcauucgggaccggcgacguaaacgaccccgucgaaaaacgauucggaaaaauagcuaaccccaccguccauaucugccuaaaccaaguuagggugcuacucgacgaaaucauagcgaaguacgguuacccauacgaaguaaauaucgagcuagcgagggaacucaagcaaaaccacgaacaacggcagcgaucgaucaaacaacaagccgcaaacaaaaaggagaacgaggaaauacgaagagaaaucaagcaagcguauaagguagaaaaagcaagaauaaucacugauuccgaaaucagucgcgcggacauugaaaaguggcgccucuggcgcagaucaaaauccaagcucugcgucuacagcggcaagaaaauuugcgaaacgaugauacucaacaacgaagucgaaguagaucacauacuaccccggagucgcaccggcgacaauucauaccaaaacaaaguccucguauuaaacaaagcaaaccgaaucaaaagcaaccgcaccccaugggaggcgaaagaacuauucgaagcccaaggauggagcuacgaagacauuuugaaccgcaugcgggcacucgacaaacaccaacucuuccgcuucgccgagaacucaauggacaucugggauaaaaacuaccguuccuucgaggccagagcccucaacgacacccgcuacaucuccagagucguaaaagacuaccucaaagugguaugccacaaggaccgcauaguaguaaguaauggagcccacaccgcgcuaauaaggagggaguucggacucaacgaucuccucggcaagaagggagagaaaaaccgcgacgaccacaggcaccacgcgauagacgcgugcgucaucggugcacuagacagaucgaugcuccgcaagcuacagaucgcuauggaaguagccgagaagcaaaacagcgcgaggaacuucgucggacuccaagaaccaugguucaacuucucaacccaagugcgaagaagcauagggcaaauauacgucucgcacaagccaaaccacaacuacgaaggagaaauauucgaagcaucuaucuauggacuacgccugauauccgacaaaaggaccgaaaaguacgucggaauaaaacgaaacccggaaacaggcaagacugacaaacccaagaaaucagucgugguaauauccgacccaaaaacccaaaacagauacggucuccgccauaaauuucauucggaaggccugccaaagaaauauuacggacugagcagcucaagcguauucugccuggaaaucuaccgagacgagaaaggaaacuggcaggcguacaccaucccccgauacgaagcauaccggaucguaaaacgccgcggaguaaacgcacuauacgacaacaaacgaucuaacuucgagggccgaccucucguaaugagacugaugcgagaugacuguaucgccuuugagaaaaacggcgucaaggaaguauaccgaauacagaagaucaauggccuuaagaagaacaucacgcucacgcgacacuucgacgcaaauguggacgaccgcuacaggcgcauguuaaaagcccaaaaggcagagaaagcgggugaagacuucgacuccgaagaccuaugcgacgaccucgucuucuccagcuucggcgcuagcucacucuacagcaacaaagccagaaaggucacuauaagccccaugggcguacuucgagacccaggcuuuaaaggauga

SEQ ID NO: 7375 - RNA, 3267 nt, Artificial Sequence; identical to SEQ ID NO: 1575
  Cas9 variant

SEQ ID NO: 7376 - RNA, 3267 nt, Artificial Sequence
  Cas9 variant
augaacuacaagauggggcuggauaucggaaucgccagcguaggaugggccgucaucaaccucgaucugaaacgaaucgaggaccuggguguccggauuuucgacaaggccgagcacccucagaauggcgagucucuggcguugccgcgacggaucgcacgcagcgcccgucgccggcugcgccgccgaaagcaucggcucgagcgcauucggcgccugcucguguccgagaacguucuaaccaaggaggagaugaaccugcuguuuaagcagaagaaacaaaucgacguguggcagcuccggguagacgcucuggagcgaaagcugaacaacgacgagcucgcgcggguccugcugcaccucgccaagcgccguggcuucaagagcaaccgcaagucagagcguaacucuaaagaaucgagcgaguuccugaaaaacauugaagagaaccaauccauacuggcccaauaccgcagcgugggcgagaugauugugaaagacucaaaguucgccuaccacaagcgcaacaagcucgauagcuacagcaacaugauugcgcgggacgaucuggagagggagauaaaguuaauuuuugaaaagcagcgggaguuuaauaaccccgucuguaccgagcgccucgaggagaaguaccugaacauauggaguucccagcggcccuucgccagcaaggaggacaucgagaagaagguaggcuucugcacguucgagcccaaggaaaagcgcgccccaaaggccaccuacaccuuccagaguuucaucguaugggagcacaucaacaaacuccggcuuguaagcccggacgagaccagagccuuaacugagaucgagagaaaccugcucuauaagcaagcauucuccaagaacaagaugaccuacuacgacaucagaaagcugcugaaccucagcgaugacauccacuucaaggggcugcuguacgaccccaagucuucccugaaacagaucgaaaauauacgguuccuggagcuggacagcuaccacaagauccgcaaaugcaucgagaacgucuacggcaaggacggcauccggauguuuaaugagaccgacaucgauaccuucggcuacgcccucacuaucuucaaagacgacgaggauaucguggccuaccugcaaaacgaguacaucacgaagaacgggaaacgcguaagcaaccuugccaacaagguguacgacaagagucucaucgacgagcugcugaaccucucguucagcaaguucgcccaccucaguaugaaggcgaucagaaacauccuacccuacauggagcaaggagagaucuauucaaaggccugcgagcucgccggguacaacuucaccgggccgaagaagaaggagaaggcccugcugcugcccgugaucccuaacauagcaaaucccgucgugaugcgagcccuaacacaaucucggaaagucgucaacgccauaauaaagaaauacggcagcccgguguccauucacauugagcuggcccgcgaccuaagccacuccuucgacgaacggaaaaagauccagaaggaccagacggagaaccgcaaaaagaaugagaccgccauaaaacagcucaucgaguacgaguuaaccaagaaccccaccgggcuggauauagugaaauucaagcucuggagcgagcagcagggccgcugcauguacagccugaagcccauugagcuggagcggcuccuagagcccggcuaugucgagguggaccacauccuaccuuacagccgaucccucgacgacagcuacgccaauaagguccugguccugacgaaagaaaacagggaaaaaggcaaucacacacccguggaauaccuugggcugggguccgagagauggaagaaguucgagaaguucguacuugcgaacaaacaguucagcaagaagaagaagcagaaccuccugcggcuccgcuacgaggagaccgaagagaaggaguucaaggagcgcaaccucaacgauaccagauacauaagcaaguucuucgcgaacuucaucaaggaacaccucaaguucgcggacggcgacggcggccagaagguguacaccauuaacgggaagaucaccgcccaccuacggucccgcugggacuucaauaagaaccgggaagagucugaccuacaccaugcgguggacgcugucaucguggccugcgccacacaagggaugaucaaaaagauuaccgaguucuacaaagcccgcgagcaaaacaaggagagcgcuaagaagaaagagcccauuuucccccaaccguggccccauuucgccgacgagcugaaggcccggcugaguaaguucccccaggaguccauagaggccuucgcccuuggcaacuacgaccgcaagaagcuggagucgcuccggcccguauuuguaucacgcaugccgaagcggagcguuacgggggcggcccaccaggagacccuccgccguugcguggguauugacgagcaguccgggaagauucaaaccgcggucaagaccaagcugagcgacaucaaguuagacaaggacggccacuuccccauguaccagaaggaguccgacccccgcacuuaugaggccauacggcagcgccuccuggagcacaacaaugaucccaaaaaggccuuccaggagccgcuguauaagcccaagaaaaacggugagcccgggccggugauccggaccgugaaaaucaucgacaccaagaacaaggucgugcacuuagacggcagcaagacgguggccuacaacuccaacaucgugagaaccgacguguuugagaaggacgggaaauacuacugcgugcccgucuacaccauggacauuaugaaggguacccugcccaauaaggcuaucgaggccaauaaacccuacagcgaguggaaggagaugacggaggaguacacguuccaauucucccuguuuccgaacgaccucgugcgcaucgugcugccucgggagaaaaccauaaagacaagcacgaacgaagagaucauaaucaaggacaucuucgccuacuauaagaccauugacucugcgaccgggggccuggagcucaucagccacgauaggaacuucagccugcgcggugucgggucuaaaacccugaagcgcuucgagaaguaccaggucgacgugcucggcaacauccauaaggugaagggcgagaaacggguggggcuggccgcccccaccaaccagaagaaagguaagaccguggacagccugcaaagugugagcgacuga

SEQ ID NO: 7377 - RNA, 3270 nt, Artificial Sequence
  Cas9 variant
augaccgcuuucaaaccaaauccccucaacuacauccugggccucgacaucggcauugcaagcguaggcugggcaaugguagaaauagacgacaaagaaaaccccguacgccucaucgaccugggagucaggguauuugaacgggcggaaaugcccaagacuggagacucacuagcggcagcccgcagacucgcccgcucgguacggagacucacaaggcgccgcgcucaccggcuucugcgcgccaggcgccuacuaaagcacgaaggggugcucaagccagaagacuucgaugagaacgggcuagucaaaccccuacccuacauaccaaaacaaccccgcaacacacccuggcagcuaagggcagcggccuuagaccgaaaacugaccccacucgaaugggcagccguacuacuucaccuagucaaacacagaggauaucuaagucagcguaagaacgaaggagaaaccgacgacaaagagcuaggagcccuauuaaaaggcguagcggacaacacacacgcccuacaagccggaaacuuccgcacgccggccgaacucgcacugaacaaauucgaaaaagaaucaggccacauccgaaaccaacgcggcgacuacucacacacauucagcagaaaagacuuacaggcagagcucguccuacuuuucgaaaaacaaaaggaguucggaaaccccuacguaagcgacgauuuaaagaacggcaucgaaaacuuacucaugacccaacgcccagcucucuccggagaugcgauucagaagaugcuaggccacugcacguucgaaccagcggaacccaaagcagcgaaaaacaccuacacugccgaacgauucaucugguugacgaaacucaacaaccuacgcauacuaaaccaaggaaacgaacgcccacucacagacgcagaacgaaccacacugauggacgaacccuacaaaaagagcaaacuaacguacgcucaagcacgcaaacuccucgaucuagacgauacggccuucuucaagggccugcgguacggcaaagacaacgcagaaagcgcaacccuaauggaaaugaaggccuaccacgcaaucuccagagcgcucgaaaaggaaggacucaaggacaagaaaaguccccuuagccuuagcccagaacuacaagaugaaauaggcacagccuucagccucuucaaaacagaugaggaaaucaccggcagacucaagggcugcuuacagcccgaaauacucgaugcacuccucaaacacaucuccuucgacaaauucguccaaauuucacucaaagcacuacgccggauagucccccucauggagcaaggaaaacgcuaugaugaagcgugcgccgaaaucuauggcgaccaccauggacgcagaaauagcgaagagacucuauaccucccgcccauacccgcagacgaaauacgcaacccaguuguccuccgagcccuaucacaagccagaaaaguaauaaacgggguagggcgacgcuacggaucgccagcccgcauccacauagagacagcucgggaagucgggaagucauucaaggaccgaaaagagaucgaaaaacgccaagaggaaaaccgcaaagaccgggaaaaagccgcagcagaguuccaagaauacuucccaaacuucguaggagaaccaaagucuaaagacauccugaaguuacgacuguauaggcaacaaaacugcaaaugccucuauaguggcaaagaaaucaaucucgguagacucaaugaaaaaggauaugucgagaucgaccacgcccugcccuucagccgaacaugggacgacagcuucaacaacaaagugcucgugcucgggagugaaaaucaaaacaaaggcaaccggacaccauaugaauaccuuaacggcaaagacaacucaagagaauggcaagaguucaaagcccgaguugagacgucacgguucccccacagcaagaagcagcgaauccuccuacaaaaauucgaugaagaaggguuuaaggaacgcaaccugaacgacaccagguacgucaaccgauuccucuguaaguuuguagcggaccacaugcagcucacagggaaaggcaaacgccgcgucuucgcaagcaacggucaaauaaccaaccuccuccgcggguucuggggccugcgaaaggucagggcagaaaacgacagacaccacgcacucgacgcgguagucgucgcgugcagcacagucgccaugcagcaaaggaucacccgcuucguccgauacaaagaaaugaaugcauucgauggcaagaccgucgacaaggaaacaggcgaaguccuccaucagaaaacacacuucccccaacccugggaguucuucgcccaagaaguaaugauccgcguguucggcaaaccagacggcaagcccgaacuagaagaagcagauacaccagaaaaacuacgcgcccuucucgccgaaaagcucucaagccgaccagaagcgguccacgaguauguagcaccccucuucgucucacgagcaccuaaccgcaaaaugagcggacaaggacacauggaaaccaucaaaucacccaagaggcuagacgagggcaucuccguagugcgcguaccgcucacacaacuaaaacucaaggaccuggaaaagaugguaaaccgcgaacgcgagccaaaacucuacgaagcgcuaaaagcccgucuugaagcccacaaagacgacccagcaaaagcauucgcggagccauucuacaaacaagacaaggccggcaaccguacccagcaagugaaagccgugcgaaucgaacaaguacagaaaaccggcgucugggugagaaaccaaaacggaauagccgacaacgccaccaugguacgaguagauguauuugaaaaaggagggaaauacuaccucgugcccauauacucguggcaaguagccaaaggcauuuugcccgacaaagcaaucauagccuucaaagacgaagaggaauggcaacuuaucgacgacagcuucaacuucaaguucccccuacacccuaacgaucuagucgaagugaucacaaagaaagcucgaaucuucggguacuucgcuagcugccaccgaggcaccggcaauauaaacauccgaauccacgaccucgauaauaaaguaggcaaaaacggaauccucgagggcauaggcgucaaaacagcccucaguuuccaaaaauaccaaaucgacgagcucgggaaagaaauacgacccugccgccugaagaaacgcccgcccguccgauga

SEQ ID NO: 7378 - RNA, 3270 nt, Artificial Sequence
  Cas9 variant
augaacguacgcuauaagauaggacuggauauaggcaucaccucagugggaugggcggugguaaaccuagacauaccacggauugaggaccucggcguuagaaucuucgacagagccgagaacccccaaaccggcgaaagccuagcucuaccgcgucgacuagcacgauccgcuagacgccgacugcgcagacggaaacaccggcuggagagaauccggcgccuacucauccgcgaaggcauccuuaugaaagaggaacucgacaaacucuucgaggagcgacaugaaauugacguauggcaacuccgcgucgaggcccucgaccgaaaacuaaauuccgacgaacucgcacguguguuacuccaccucgcgaagcgaagaggauucaaaaguaaccgcaaaucagaacacaacucccgugagaacuccacgaugcuaaaacacaucgaagaaaaccgggcuauacucucaucauaccguacagucgccgaaaugaucguuaaagaccccaaguucgcccuccacaaaaggaacaaaggagagcacuacacaaacaccaucgcccgggacgaccucgaacgagagauccagcucauauucacaaaacaacgcgaguucggcaacaugaacugcaccaaagaguucgaaaacgaauacauagcaaucugggccucucagcgcccauucgccucaaaggacgacauagaaaagaaagucggauucugcacauucgaaccaaaagaaaaacgcgccccuaaagcaacauacacauuccaaucauucaucgccugggaacacauaaacaaacuccgucucgucucccccgccggaacccguggccugacugacgaagaacgcagacuacucuacgaacaggcauuccaaaagaacaaaauaaccuaccacgauauacgcacgcuacuccgccucccagacgacacguacuucaaaggagucgucuacgaccgaaacaugccacugaagcaaaacgaaaccauacgauuccucgaacucgacgcauaccaccaaauaagaaagguuaucgacaaagccuacggcaaaggcaaaucgagcucauuccuaccuaucgacuucgacacauucgguuacgcacucacacuuuucaaagacgacgcagacguacgcucuuaccuccagaacgaauacgaacaaaauggcaagccgaugccaaaccucgccaacaaaaccuacgacaacgaacucauagaggaacugcucaacuugagcuucaccaaguucggacaccucucacucaaagcccuacacaacauccuacccuacauggaacaaggugaaguauacucgucagccugcgagcgagccggauacaaguuuaccggcccgcggaagaaacagaaaacaaugcuucucccaaacauuccgagcauugcuaaccccguaguaaugcgcgcgcucacacaagcacgaaaagucgucaacgccaucauaaagaaauacggcuccccagugagcauacacaucgaacuggcacgagaccucagccaaacauucgacgagcgaagaaaaacaaagcgggaacaagacgaaaaccgaaagaaaaacgaaaccgccauaagacaacuaauggaguacggccuaacgcugaacccaaccggccacgacauagucaaauucaaacuauggucagagcaaaauggaagaugcgccuacucucuccaacccaucgaaauagagcgacuccucgaaccagguuacaccgaaguagaucacgucauucccuacuccagaucccucgaugacucuuacaccaacaagguucuaguacugaccaaggagaaucgagaaaagggcaaucgcacucccgccgaauacuuaggagucggaaccgagcgcuggcaccaauucgaaacguucguguuaaccaacaaacaguucuccaaaaagaaacgugaccggcuccuacgccuccacuacgacgaaaacgaagagacggaguucaaaaaccggaaccuaaacgacacacgcuauaucagccgauucuucgcaaacuucauaagagaacaccuaaaauucgcggaaagcgaugacaaacaaaagguauacaccgugaacggccgcauaaccgcacaccuacgcucccggugggaguucaacaaaaaccgugaagaaagcgaccuccaccacgccguagacgcagcaauugucgcgugcaccacgccaucagacauagccaaaaucaccgcauucuaucaacgacgcgaacagaacaaagaauuagccaagaaaaccgaaccucacuucccccaacccuggccucacuuugccgacgaacuucgugcccgacucagcaaacaccccaaagaauccaucaaggcacucaacuuaggcaacuaugacaacgagaaacuagagucacuccacccaguguucgucagccgaaugcccaaacgauccguaacaggagccgcccaucaagagacccuacgccguuacgucgggaucgaugaacgaagcggaaaaauccagaccgucguaaagacaaagcucucagaaaucaaacucgacgcuucgggacauuuccccauguauggaaaagaaagcgacccgcgaaccuacgaagcaauacgacaaagacuccuagaacauaacaacgacccuaagaaggccuuccaagaaccccucuauaagcccaagaaaaacggagaacccggccccauaauccgcacagucaaaauaaucgacacgaaaaaccaaguggucccccugaacgacggcaagacagucgccuauaacaguaacauaguccgcguagacguguucgaaaaagacggcaaguacuacugcguucccguguauacaauggacaucaugaaaggaguuuuaccaaacaaagcaaucgaaccuaacaaaccauacucagaauggaaagaaaugacagaagauuacaccuuccaauucagucuguacccaaaugaccuuauucgcaucgagcuaccaagagagaaagccauacgcaccucaacaggagaagaaaucaaaaucaaagacuucuucgcauacuacaaaaccauccacucaggaaccgggggcauggaacucauaucucacgacagauccuucucccuuuccggagucggaagcagaacccuaaaaagauucgaaaaauaccaaguagacgugcugggcaauaucuacaaaguacgaggcgaaaaacggguaggccucgccucuucagcgcacucuaaaacaggaaaaacgguacgcccccuccaaagcacacgcgacuga

SEQ ID NO: 7379 - RNA, 3273 nt, Artificial Sequence
  Cas9 variant
augcgcuggagacugggacuggauaugggcgcaggaucacucggauggugcgcagucggauuagacgaucagggauacccggacagcauacuagcggcaggaucgcacaucuucggcgacgggcgagcaccaucacgcggagaccaacaaggcaccccgcuuggggucgaacggagggcagcaaaagcgaugcggcgucggcgugaccgguuccucggcagacaagcuaaacuccuagccagacucacgcucgcgggcuuguucccugccgaccccguucgcgcgaaagcacucgagcuccuagacccauacgugcuaagagcacgcgcucuggacgaggcauugccaccgcaccaacuaggacgagcguucuuccaucuaaaucaacgccgaggauucaaaagcaacagaaaaacagacagaggcguagacgacgaagcaggaaagaucgcaaucggaaucgaccgucugagagcagccauagccgcagcagaggcccgcaccaugggugaguucuugcacaaacgaagacaaucagccccugacguaaaccagauccccagcguccguacacgacucagaccagagacgggagaagaagccaaaggagacggauaugacuucuacccaggccgagagcuaguagaggaagaguucgacgccauaugggacgcacaagcgccacaccacccaagucuacucacgcccgacaaccgcgcccuucuccacgaagccaucuucuaucagcgcccacuuaaggccccgaaaauaggaaaaugcacgcuacuaaacaacgaaccacgacuaccuaaagcccauccacuauuccaacgaaggcgacuccucgaggaaguaaacgcacuaagaaucgugcgaccgggcgagguggccaccaaguuaacuugcgagcaaagggaccuacucauguuaaaacuaaaagauaaagcaaaggucucauucgaaacccugcgaagcaaaguacugaaacuagagcccgaggcccgguuuaauaaagaaggcgaaaaccgaacagaauuagugggagacgaggugugcgcacaaaugagcgcaaaaaccagauucggaaaggcgugggcucacuucacagacgagaaacguugggcgauacuaagcagacucauagaagaggaagacgaagaaagacucgacacauggcucaggacagaacacggacuggacgcagaacaagccagggcaguggcaggagcacggcucccggccggauuuggacgauucggagaaacagccacgagacgccuaaucgccgcauugcaagcagaagucaucguguacucagaggcgguaguggcggcaggccuaggucaucacucagacaugcgaacaggcgagguccuggcagaacucccauacuacgggaugacacucgagaggcaccuccuccccggaacgggcgacaaagcagauccagaagaauuacgaaucggacgccugacaaaccccacaguccacaucgcucucaaucgacuaaggagaauaguaaaucgacucauaaaaaccuacggacgcccugaacaaaucgcgaucgaacucgggcgagaacucaaacucacagacgaggacaagcaaagacucucaaggcagaacaaccgcaacagagcggacgcagaagcgcguucaaagaaacuugcagaacuaggacaagcagacaacggagcaaaccgcgcacgccuaaaacugugggaggaacuaaacagagaaaacgcccuagacagacgcugcauuuacagcggacaacaaauaagcauugcgaugcuguucagcgacgcaguagaagucgaucacauacucccauuugacgcuacauuagacgauucgaacaacaacagaauuuuaugccuacgcgaauggaaccgaagaaaaagaaaacaaagccccuacgaagcauggggacacaccgacuauuggccugacaucgccgcccgggccgcacgccugcccaaagaaaaacgcuggcgcuucgagccggacgccaugcagcgauucucggcagaagaucguuucaucgcgcgacaccuuguagacacucaauacaugucacgacuagccagagaauacuuagaagccuuauaccccgaaaaaggcgaaggaagcggccaugucuggguaucaccugggagacuaaccgaacuuauacgaagaaaacucgggcugaacgagcuacuccccgaucacaacuucgccggagugaaaaaccggcuagaccaccgccaccacacgaucgacgcauucguaguagcagugaccgacagaagucuacuacaagggaucucgagggcaagugcacucgaaggagaagaaggccgagagaggguaauaguaccagaaccuugggacggcuucagagaagcacuaagaacaacacucaacacgaucaccguguggcaccgccaggaccacggcacagcuucaaaagccggacuugcacagggccgagaccaaacggcaggaaaacuccauaacgacacugccuacggucucacaggccgacaagacacaaaaggcaacgaccuaguggugagccgaaaaccacugaugagccuuaaacccgcagacaucgagccaguccccgacguggcaccaaucacaaaaggcgugcgcgacagagaccuaagaaaagcgcucgcacacuucacccaggccacagaggggaaaggguuccuacaagcccucgaacgcuucacaagacucgggccacugcacuuccgcgggauaaggcguguccgccuuauccagccacuagcaguaauaccaaucaaaggacccggaggagucccauacaagggauaucuaggaggugagaacuuucgcugugacguaugggaaaugccagacggagccuggaaaccugaaguaacauccauguuucaagcgcaccaaccaggauggacgagugcaaucagagcagcaugcccgaccgcacggaagguacuaagccuccacaagcgcgacaugauagccauagaaagggaggagggcguacgcacguuaauggugguagcccaaauauggagcaacggucaaguaacacucguggaaccacacgaagcaggcgaccugaacaagcggaacaaaucggaagaugacccguucggguacuuuaugccgaccgcaggaggccuaaaacgacuaaaggcgcgacaaguucgcguggacgaacuaggacgaguacaggacccaggcuuucccgcgcgcaaggccagacggaggacccgucccaaacaaguggacuga

SEQ ID NO: 7380 - RNA, 3273 nt, Artificial Sequence
  Cas9 variant
auggacuggcgccuaggacuugaccucggcgcaaauucacuaggcugggcagcgcugagguuggaccgagcuggcgaccccaucggcauacuggccaugggaucccgcaucuucucagacgggcgcgaccccaaguccggagccucccuugcgguagaccgccgagccgcacgcgcaaugcgucgacgacgugacagauucaaacaacgacaggcagcgcuucuaaaauaccucauaagagacgggcucuuuccagcagaccaagcagaccgacaacgacucgccgaugaagacccguacgcacucagagcccgagcucuggacgaagaauugucccuauuugaaauaggcagagcacuguuccaccugaaccaacgcagaggauuccaaagcaaucgcaaggccgacagaggacaggacgacgaagcaggcaagaucgcagucggggucgaucggcuaaaucagcagauggaggaacaaggcgcacgcacacugggagaauuucugcaucaaagacggcgcgcagcaacagacgccaaccacauacccagcguccgcacacgacugagaccagagaccggcgaaggcgccaagggugacggcuacgacuucuacccaagucgagcacucauagcagaggaguucgaagaaauaugggcggcccaagcaccacacuaccccgacacacuuacccagcaaguacacgacagacuauacgaaauaaucuuccaccaaaggccucucagagcaccccaggucggccaauguacacucguagccggagaaacccgacuccccaaagcccacccacuuuuccagaaaaggcgacuccuagaagaaauaaacgcacuaaugauaguccgaccaggggaaauagcacaacgccuaacaccggaagaaagagauacccuauaccugaaacuaaaagacaaacgaacagucagcuucgcgacgcuacgaaaaacacuaaagcuggacucagccgcacguuucaauaaggaauccgagaaccgaacagagcugaaaggagacgaggucgcggcggaacugggagcaaaaacccgacuaggaacgcgguggcaacaccugagcggggaccaacaaugggaaguaguacaccgcuuaauggcccucgaaagccaggcagaugaggccgcauucagggacuggaucucccagacguacgaccuacucccagaacaagcggcugccguacuaggagcgcgacucccacaaggccacgggcgcuucggaccaaccgcgaccaccacccucauugacagucugcuacacgacaggacagaagacggccgcgucguaguauacagcgaagcaguacaacgaagcggacucggacaccacagcgaucucagacacgaccgagacgacgaagacgucacagaacuacccuauuacgggguagcacuagaaagacauaucaugcccgggacagcggaaccaacagaucccgaggaaaugcgcaucggcagacuaacaaauccaacuguccacauaggccuaaaucaacugcgacacguaguaaaccgccuaauacgagcauauggcccaccuaaagaaauagccaucgaacuggcuagagaacugaaacugagcgaagacgaaaagaagaaacgaaacuccgaaaacagagacaaccgacuggcagccgaagguaggucaaagaaacuagaagaaauccgacagcgcgacaccggagccaacagagcccuacuaaaacuaugggaggaacuaaacccgggaaacguccucgacagaagaugcauauacaccggagaacagauaagcauagacaugcuauucuccgacagggucgaagucgaccacauacugcccuucgcacagacccuugaugacuccaacggcaacaaacuccuaugccugcgagaagcgaacagagaaaaacgaagaaggagcccauacgaagcauggggucacaccgacagguggcccgacauagccgagcgcgcaucaaggcuaccaaaaccaaaaagguggcgauucgaacccgacgccaugcaaagauucgcaacagaggacggcuuccuggcccggcaccucgucgacacacaauaccuaggaagacuagccagagaauaccuuucgugguuauacccaggaaggggcgaaggcaguggacacguauggguaagcccaggccgccuaaccgaaaugguacgucgcaaacuaggacuaaacgaccugcuccccgaccauaacuucggcgggggagcagaccagcccaaaaaccggcucgaccaccgacaccacgcuaucgacgcccuaguaguagcaaucguagaccgcggcaugcuccaagcuauagcccgagcaucaggccaggacggaagugaggguagagaaagaauccacaucccagcgccgugggauggcuuccgcgacgaucuccgcgucgccgucaacggcaucauaguaagccacagaccagaccacgggacaguggccaaggcagggcuagcacgaggaagagaccaaaccgccggcagacuccacaacgacacagccuauggccuaacaggugagaccgacgccaagggaaacagcaucguaguacgaagaauaccccucucagcaaucaagaaacccgcagauauagcccgggucagggacccacuacuacgcaacgcacuugccgaguucaccaaaggccuggacggaaaagcauucgaagcaaggauaggaagauuccacgaacugggcccacuccucuaucgugggauccgacgcguacgggucguagaaacccucacugugauacccaucagagacgccgaaggacgagcauacaaaggcuacaaaggcgacagcaacuaccgcuacgacgucugggaaaugccggacggcaaauggcguugccaaguagucagcauguucgacgcacaccaguccacugaacaggcaagaccacauccagcggcacgaaaaauacucucacuucagagaaacgacauccuggcgauagagagaacagaaggggaccgggaacucguccgagucgucaaauucagcgagaaacaauucgccgucgcucccccacacgaaggaggaucacucaaaacacgcgacggcaacgcagacgauccauuccgauaccuauaccccucgccuaacacccuaaaaggauggagggcgcgccaaguaagaauagacgaacugggucggguccuggacccgggauucccggcacgcaaaucgguaagacgaacccgaccucgagcagcccccguggacuga

SEQ ID NO: 7381 - RNA, 3276 nt, Artificial Sequence
  Cas9 variant
auguauuccaaccuccuauucucuuucgacauaggcaccaacaguaucggcuggugcguauucgcacuagacgaggcgggagagccguauagaauaguagaccugggcgcgagaauauacgcggacggccgugacccacaaagcaaaacaagccuagccguagcccgaagagaggcucgcgcuaugucccgacgaagggacagauaccuccgaaggcgaaaagcaacacucagaaccaugaucgaguacggccucaugcccggcgacaaagcgggccaggaagcaguccuccgcgaaacgggcgaccgagagggcggcgacgagagcuucaacccguacgcccuacgagcaagggcacuaagcgaaaaacuacccccggccuacaucggaagaguccuauuccaccucgggcagcgccgaggcuuuaaaucaaacagaaagacagacaggaaagacaacgacaaaggcaaaauagcacuggggauagacgaacucacagcagccaugcaucguucaggaucacccacccuaggagcauggcuagccaugcgccgagcggaaggccacaguguacgccuacgagcaggaagcgagguguucgacgccgaaggauacgcguuuuacccagagagaucucuacucgaagacgaguuucgccagaucugggacgcccaagccguccaccaccccgauauacuaacaccggagcggcgugcacaccuauuccgggugauguucuaccaacgaccgcuaaagaaaccacucgugggacggugcagcuucaacccagcggaauuuagacuaaguagagcacacccuuuguuucaagaguuccgccucuacaaagaaaucaaugaccucgaagucguccuaccagaccaaucucacagaaaacucacguuggacgaacgcaacgcccuaguagcaaaacuaaaaacgagccgcaaagcaucauucucagcacuaagaaaaacacucaaacugaccccugacuuggucuucaacaaagagucggaagcacgaaaagaacugcucggagacgagaucuacagcguacucgcagacgcgaaaauguucggcgcacgguggggcggauuuuccagagcuaggcaaugggaaauaauaacccggcucaaagaagaagaagaccccgccucacuuucaaguugguuaaaaagugaguucggacucgaugacgaacgaguuaccgcaauagccaacgccucccuuccggacggauacggccgccucggagaaacagcacucgcaagcaugcuagaagaacucaagaccgccgucauaccagaaagcgaagcagcgcggcucugcggauacgaccacagcaaccuggccaaggaacaagacgaaggacuagacacccuaccggaauaccaggaaauccuggagcgacacauaccucccggaacaggggaucccgacgacaucuacgaccuacggaaaggcagaaucacgaaucccacugugcacauaggacucaaccaacucagacggguagugaaugcccucauacaccgguuuggcagaccccaacggauaguaguagagcuagcccgugaccuccaacugucagaaaaacaaaaggacgauguaaaccgccgaauagccaaaaauacccgagaagcagagggaaggagccaaaaacucauugaaaugggacagcucgacacaggguacaaucgacuacuacuaaaacuaugggaagaacugaaccucgacaaacccgaagacagaguaugcauauauucaggcaagcccaucgggauagcaaugcuauucagcggcgaggucgacgucgaccauauacuaccguggucgaaaacacuagacgacucgcaagccaacaaacuccuaugccuaaaguccgcgaacaggcagaaaagaaaccggaccccaagcgacgucccagaauggagagaccgauacgacgaaguacucgccagggccgcacgccucccccgcaauaaaagguggcgguucgcugccgacgcaaugcaacaauuugaagccgaagggggcuuucuagcccgccaauuaacggauacacaauaccucuccagaauggcccuagaauaccuauccgcgcucuaccccucggaagaagccgauaagagcggggaacuccgccaacguaagcgaguacacgucgucccaggaagacucaccgaacuucuacgccgaaauuggggccucaacacacuacugccggaccacaaucuaggcgaaauggcacaagaaaagaacagaagggaucaccggcaccacgcaauagacgccgcggugauaggaaccaccucacgcucacuacugcaacgcaugaguggagcagcagcccgccuggacgauguggcguucgacgaccugguccgcacgguugucaaagacaaucccccuuggccaggauuucgagaagaacuccuagccgccaucggaagaguaacgguaagccacaaacccgaucacggaaccgucucacgggcagcauacgcgcaaggcaaaggccaaaccgcgggaaaacuucacaacgacacggcguacggacucaccggccuaguagaugcaaaaggaagcccacucguaguccgacgcaagccauucauggccuuagaaguuaaagacauagcaucgauacgcgauaccgaacugcaaagugcacuauacggagcaauaggcagccucacagaaaagaaagcgcuacaagaggcgcucauacgcuuccgagacacccacccacaauucaaagguauacgcagaguccgcgugcuugaaacccugucagucaucccaaucguagaccgcgauggcaaagccuacaaaggauacaaaggcgaugcuaacuacagguacgaggucugggaaacacucgacggaaaauggcacacggaaguggucuccauguucgacgcccaccaaccaggguggcaaagccccuuccacaaacagaaccccgcagcccggcgagugcugaagcugcagcagaacgacaugguugccuacgagcacccugcggacggguacaccauagcccgggucgucaaauucaguaacgacaaaagaaucuacuucgcuucccaccgagagucagguagccucaaagcgcgggacgcggauaagggagaccccuucaguuacuucgccaaagcaaacaacggccuccgcgacauaaagugccgacaaguacgaaucgacgccgccggacgcauauucgacccaggaccucaggaccgcgagacacgacaagccaacaaaggaguauga

SEQ ID NO: 7382 - RNA, 3279 nt, Artificial Sequence
  Cas9 variant
auggccuacacaaugggaaucgacguagggauagcauccugcgggugggcaauaguagaccucgaacgacaaaggauuauagacaucggagugcgcacauucgagaaagcagaaaacccgaaaaacggcgaagcacuagcgguaccacgccgcgaagcccgcuccucacgccgccgacuacgcagaaagaaacaccgcaucgaacggcuaaaauacauguucguacgaaacggccuugccgucgacauccaacaccucgagcaaacauuacgaagccagaacgaaaucgacguuuggcagcuacgcguggacggacuugaccgcaugcucacgcagaaagaguggcuuaggguacuuauccacuuggcacagcgccggggcuuccaauccaacagaaaaacagacggcucaagcgaggacgggcaaguacucgucaacguuacagaaaacgaucgccuaauggaagaaaaagacuaccgcacagucgcagaaaugauggucaaagacgaaaaguucagcgaccacaaaagaaacaagaacggaaacuaccacggcgucgucucacgcgccucgcuacuuguagaaauacacacgcuauucgaaucccagcgccagcaccacaacuuccucgccuccaaggacuucgaacucgaauacauaaauauauggucaucgcaacgcccagucgcaaccaaagaccaaaucgagaagaugaucgggacaugcacauuccugcccaaggaaaaacgagcgccuaaagcauccuggcacuuccaauacuucaugcuucuucaaaccauaaaccacauacgaauaacaaacgcacaaggaacucgcccccucaacaaagaagagauagaacagguagucaauauggcgcucacaaaauccaaagucuccuaccacgacauacgaaaaguacucgaccucucagaagaguaucaauucguaggccucgacuacgggaaagaagacgagaagaaaaagguugaguccaaagagaccaucauaaagcuagacgacuaccacaagcucaacaaaaucuucaacgaagucgaacuugcaaagggggaaacuugggaagcagucgauuacgacacggucgcuuacgcccucacauucuucaaggacgacgaagacauaagagauuaccuacagaacaaguacaaagacuccaaaaaccgccuagucaaaaacguagcgaacaaagaauacaccaacgagcucaucgaaaagguauccacccucagcuuccgaaaagucggacaccugucucugaaagcccuucgaaaaaucaucccuuuccucgagcaaggaaugaccuacgacaaggccugccaagcagccggcuucaacuuucagggaauaaguaagaagaaaagaucaguaguccuaccgguuauugaccaaauaagcaacccaguaguaaaccgagcccucacgcagacccgaaaaguaaucaacgcacuaauaaagaaauacgggucacccgaaacgauacacauagaaaccgccagagagcuaucgaaacguuucgacgagcgcaaaaacaucaccaaagacuacaaagaaaaccgcgacaaaaacgaaagggcuaagaaacaccuaucagaacucggaaucaucaaccccacaggccuagauaucgugaaauacaaacucuggugcgaacaacaggggcggugcauguacucuaaccaacccauuuccuucgagcgacugagggaauccggauacacggaaguagaccacaucauaccguacucaagaagcaugaacgacaguuauaacaacagaguacugguaaugacccgagagaaccgcgaaaaauccaaccaaacccccuacgaguacaugggcaacgacacccaacgaugggacgaguucgaacaacgcgucacgacaaauccgcaaaucaaaaaggaaaaacgccagaaccuccuacucaaaggcuuuacaaacaggcgagagcucgagaugcucgaaagaaaccucaacgacaccagacacauaaccaaguaccucagccacuucauauccacaaaccucgaguucagcccaagcgacaagaagaagaaagucguaaacacgagcggacgcaucacgagccaccuacgaagucgcugggggcuagagaaaaaccgagaacaaaacgaccugcaccacgccauggacgccguagucauagccguaacaucagacuccuucauacaacaaguuacaaacuacuacaaacgaaaagaacgccgcgaacuuaacggcgacgacaaauucccccucccguggaaguucuuccgcgaagaaguaauagcccgacugagccccaacccaaaggaacaaaucgaagcacugccaaaccacuucuacagcgaagacgaacuagcggaccuacagccuauuuucgugucacguaugcccaaacgcucuauaacaggggaagcgcaccaagcccaauuccgccgggucgugggcaaaacaaaagaaggcaaaaacaucacggccaagaaaacugcccuggucgacaucucguacgacaaaaacggagacuucaacauguacggccgagagaccgacccggccacuuacgaagccauuaaagagcgauaccucgaguucggaggcaacgcaaagaaagcguucuccacagaccuccauaaacccaaaaaggacggaacgaagggcccccucauaaaaucggugcgcaucauggaaaacaaaacccuggugcacccagucaacaaagguaaagggguaguuuacaauuccucaauuguaagaacugacgucuuucaacgaaaagaaaaauacuaucuccugccuguguacgucacagacgugaccaaaggcaaacuucccaacaaagugauagcagccaagaaaggcuacgacgacuggaucgaaguagacgacuccuucaccuuccucuauuccuuguacccaaacgaucucaucuucauaagacaaaacccaaagaagaaaauuucccucaaaaagcggaucgaaagccacucaauaagcgacuccaaggaaguucaagaaauuuuaacauacuacaagggaguagacucaagcaccgccgcaaucgaguucauaacccacgacgggagcuacuacgcaaagggcgucggaguccagaacuuagacuguuucgagaaauaccaagucgacauccuuggcaacuacucaaagguaaaaggcgagaaaagacuggaacucgagacauccgacaacaaucacaaagggaaagacgucaacucaauaaaauccaccagcagauga

SEQ ID NO: 7383 - RNA, 3279 nt, Artificial Sequence
  Cas9 variant
augaaguacagcaucggccuggacaucgggaucgccuccgugggcuggagcgucaucaacaaggacaaagagcgcaucgaggacaugggggugcggaucuuccagaaggccgagaaccccaaggacggcuccagccucgcguccagccgccgggagaagcgcgggucccggcgccggaaccgacggaaaaagcaccgccuugaccggaucaagaacauccugugcgaaaguggucucgugaaaaagaacgaaaucgagaaaaucuacaagaacgccuaccugaaauccccuugggagcuccgcgcuaagagccuugaggccaagaucuccaauaaggagaucgcgcagauacugcugcacaucgcaaagcggcgcgguuucaagagcuuccggaagaccgaccgcaaugccgacgacaccgggaagcuacuguccgggauccaggagaacaagaagaucauggaggagaagggguaccugacgaucggugacaugguagccaaggaccccaaguucaacacccacgugcggaauaaggcagggagcuaccuauucuccuucagccgcaaacugcuggaggacgaagugcggaagauccaggcgaagcagaaggaacucggcaacacccacuucaccgacgacguccuagagaaauacaucgagguguucaacucccagcgcaacuucgacgagggccccagcaagcccucccccuacuacagcgagaucgggcagaucgccaagaugauuggcaacugcacguucgagagcuccgagaagcggaccgccaagaacaccuggagcggggagcgcuucgucuuccugcagaagcucaacaacuucaggaucgucggccuguccggcaaacgaccccugacugaggaggagcgcgacaucguggagaaggagguguaccucaagaaggagguccgguacgagaagcugcgcaagauccuguaccucaaggaagaggagcgguucggggaccugaacuacagcaaggaugagaagcaggacaagaaaacggagaagaccaaguucauaucccugaucggcaacuacaccaucaagaaguuaaaucugagcgaaaagcugaaguccgagaucgaagaagacaagagcaagcucgacaagaucaucgagauucugaccuucaacaaauccgacaaaacgaucgagagcaaccugaagaaguuagagcugucccgcgaggauaucgagauccugcucagcgaggaguucuccgggacccuaaaccugagccucaaggccaucaagaagauccugcccuaccuggagaagggccucuccuacaaugaggccugcgagaaggcggacuacgacuacaagaacaacgggaucaaguucaagcggggcgaacugcugccggugguggacaaagaccucauugccaacccagucgugcugcgcgccaucagccagacccggaagguggucaacgccaucaucaggaaguacggcacgccccacaccauccacguggagguggcccgggaccuggcgaaguccuacgacgaccgccagaccaucaucaaggagaauaagaagcgggagcucgagaacgagaagaccaagaaguuuaucagugaggaguuugggaucaagaacgucaagggcaagcuguuacugaaguaccgccucuaucaggagcaggaggggcggugugccuacuccaggaaggaacugagccugagcgaggugauccucgacgaguccaugacagacaucgaccacaucauccccuacagccgguccauggacgacagcuacuccaacaaggugcugguucugagcggcgagaaccgcaagaaauccaaucucuugcccaaggaguacuucgaccggcaggggcgcgacugggacacguucgugcucaacgucaaggcaaugaagauccacccgcgcaagaaguccaaccuccugaaggagaaguuuacgcgggaggacaauaaggacuggaagucccgcgcacugaacgacacacgguauaucagccgcuucguggcuaacuaccucgagaacgcgcuggaguaccgggacgacagccccaagaagcgcguguucaugauccccggccagcugaccgcccagcuccgggcccgcuggcggcugaacaaagucagggagaacggcgaccugcaccacgcccucgacgccgcggugguggccgucacggaccagaaggccaucaacaacaucagcaacaucucccgguacaaagagcugaaaaacugcaaggaugugauccccagcaucgaguaucacgccgacgaggaaaccggggagguguacuucgaggaggucaaggauacccgauucccgaugcccugguccggcuucgaccuggaguugcaaaagcggcuggagagcgagaacccccgcgaggaguucuauaaccugcucuccgacaagcgguaccuggggugguucaacuacgaggagggcuucaucgagaagcugcgccccguguucgugagccggaugccgaaucgcggggucaagggccaggcgcaccaggagacaauccggucuuccaagaagaucagcaaccagauugccguguccaagaagccccucaacaguauuaagcugaaggaccuggaaaagaugcagggccgcgacacagaccggaagcucuacgaggcccugaagaacagauuagaggaguacgacgacaagcccgaaaaggccuucgccgagcccuucuacaagccgaccaacuccgggaagcgcggcccucucgugcggggcaucaaggucgaggagaagcagaacgugggcgucuacgucaacggcgggcaggcgagcaacggcuccauggugcgcaucgacguguuccggaagaacgggaaguucuacacgguccccaucuacgugcaccagacccugcucaaggagcuccccaaccgggccaucaacggcaagccguacaaggacugggaccugaucgacgggagcuucgaguuucuguacaguuucuacccgaacgaccucaucgaaaucgaguucggcaagagcaaguccaucaagaacgacaacaagcugacgaagaccgagauccccgaggugaaccugagcgagguccucggcuacuacagggggauggauaccuccaccggcgccgccacgaucgacacccaggacggaaagauccagaugcgcaucggcaucaaaaccgugaagaacaucaagaaauaccagguggacguccuggggaacguuuacaaggugaagcgggagaaacgccagaccuucuga

SEQ ID NO: 7384 - RNA, 3285 nt, Artificial Sequence
  Cas9 variant
augaaauccacgcucgcgaucgcaucaaucagcucccuaggcuggguuauugaacuuggcgaaaauagaauaaugcgacucggacucgacaucggcaguaccagcauagggugguggauauacgaaaccacagacggacagauaaccucgguuauagacggaggcguaagaaucuuuuccgacggccgagaucccaaaucaaaaggcagccuagcggucgaccgcagaguagcccgcgcacaacgaagaagacgggauagauaccuacgacgcaaagcagcgcucaugaaaagaauggccgaaguaggacugaugccaagcgauccaaaacaagcaaagcaacuugaggcguuggacccauaugaauuacgcgcacgugggcuugacgaaaccuuggaacucacagaacucggccgcgcacuguuccaccuuaaccaaaggcgcggcuucaagagcaacagaaagacugacgcaggagacaacgaaucagggaagauaaucgacgccacagcacggcuagacugggcaaugcgggaccaccgcgcacgcacauacggcgaguuccuccacaugcgacgccagaaggcagacaccccaaggacaacacccgcuguacgcacccgacucaccaucgcagcgagagacggcgccgaaaaagaagaaaguggcuaugacuucuacccagaccggcaacaucuaagggacgaguucgacgcccucugggaagcccaagcagaauaccacggcguacucacggaggaccuacgagacgaaaucggcaccauaauauuccaccaaagaccacucaagaccccgaaagucgggaaaugccuauucacaaaugaagaaaggguagcaagcgcucacccacuuaaucagcggcgcauauugguggaaacgguaaacgcccuaagaguagcccaacucggggaaguagcccgcgcccucacacucgaggaaagagacacuauccuccacgcacuggacaacaaagcccacacgaaaucacuaaguggaaugucgauuaaacuaaaagcacucggaaaggucauaaagcucaggagcgggcaauacuucacccucgaaacggcaaacagggacgccaucgcaugcgacccaguccgcgcuucccuaucaaaacccgacagaaucggaucguacuggucaacacuagaccacaaugcacaaugggaaguaguaaacaggaucagagcgguacaaagcgaugcggaccacagggaacugguggccugguuagucagccaacaccgcuuggcagcggaacacgccgaaggcgcagcauacgcaccacuacccgacggcuacucaagacuggggaucaccgcaacgaaacgcauccucgcagcccuagaggccaauguaauccccuacucgaaagccguagaaagcugcggauggcaucacuccgacgaacgaacuggcgaaguacucgaccgacuaccauacuacggggaaauacuagacagacacguaaucccaggaaccuacgacgacagcgaugacgacauaacacgcuucggacgcauaacgaacccaacaguccauauaggacugaaccaauuacggcggcuaguaaacagaaucauagaaguucacggaaaaccggacgaaauagucgucgaacucgcgagagaccugaaacuaagccaagaccaaaaagccgacguggaaagaacuauaaagaaaaacacccaagcggccauaagacgaggcgaaaaacucgaggagaugggcgugccuaacacaggaggcaaccgcaugguacuaagacucugggaagaccucaacgacgacgacguaaugaaacgauucuguccauacacagggcagaggauaucagcggggaugcuauucgacggaagcugcgacguagaccauauacuccccuucucucgaacguuagacgacggauucaccaauaaaacccucugucuaaaagaagccaacagaaagaaaagaaacuacgccccacacgaagcggcagagaaaggccuccuagaccgcgacgcaauggacuccguggccaaauaccuuccagauaauaaagccuggcgcuucgccccagacgcaaucgaaagauuugaaggggagcgugacuucacagcacgagcccuaaaagacacacaauaccuaagccggcucgcccggacauaucuggacgcacuauacgaugggggagacgacaaaagccacgucugggugguaccgggacgccugaccgagaugcucagaaggcacuggggacucaacggccuggaggcgcucgcagacagcgacgagaaaaccguaaaacgcaaaaaccgaaccgaccaccgccaccacgcgauagacgccgcuguaguagccgcgaccgacagaucccucauacagaaaauaucaaaaaucgccgccuccgacgaacaagccggcgcagaagacacccuuaaaagcacuccucccccaugggacuccuucagagacgacaucgcggcacagcuccaaaacauaaccguaagccaccgggcagaccauggccgaacagacucccuagccaaagggcgaggggaagacacaaccucaggagcccuacacgaagccaccgcacucgggauaaucgacgaaacccauguaacagugcgcauccccaucgaaucccuaaagagcgggcaccuaauagaaggcucacgcaauggauauauacgcgacccguaccucagagaccaacucacccuggcaacaaagaacggcagcgacaaggacuucaccaccguguugcaaaaauucuuugacagaucaaaacgauacggcggcacccggagaguccgaauaaucaaaacccuccaagacacggccaggaucagcgucccccacaacgcaccgauaaaggccuacaaaggaggaucaaaucacgccuucgaaauauggcgccuaccgaacggaaaaaucgaaucccagguaauaaccacaugggaacaucauaaucuaacagaacccaaacgaccgcacccggcugcaaaacgaauaaucaggcuccauaaaacggacaugguagcaaucgaacgugacggaaaaacagucaucugcuucguccaaaagacagacccgucaaauggcgcauuucucgugccccacuucgaagcgaacgcagacggaagaaaacgcaaaaacgagcccgucgaaugguaucaaaugucggcaaacagccucauaaaggccgaccugcgacgagugggcguagacgaaaugggaagaguaagagauccggggccgccacccauacgauga

SEQ ID NO: 7385 - RNA, 3285 nt, Artificial Sequence
  Cas9 variant
augaaguaucgcgucggauucgaucuaggaacgaacagccugggcugggcagucguccgcuuaaacgcaaguggagaaccagacagaauagaagucgccggaagccgcauauucagcgacggaagagaacccaaaagcggcgcaucucucgcuggagcucgucgggacgcgagagcgaugcgucgccgaagggacagauucaaacagcgccaagccgcacucaucaaauaccucacccaagcaggauuuuucccagccgacgaaagcgaacggaaagcacucucagcacucgauccauacgaacucagggccagagcacuagacgaagcccucccccuagcacaccucggcagagcacucuuccaccuuaaucaacgaaggggcuucaaauccaacaggaaaacagaccgaggcaaaaacgaugacacaggaaaaauaaggauaggcguagcccgccucuacgagcaaaugcgagacgcagacgcccgcacccucggagaguuccugcacaaacgccgagccgcagccucagacccgaaugcaauaccucacgugaggacaagaaucguaacccuagccgcagaagauggcaaagccagugacgucuaugacuuuuaccccgaccgacaaacccuagaagaagaguucgaagcaaucugggaagcccaaaccucacaccacccggaagcacuaacggaggaaagacgagcccaauucuacgaaauuaucuuccaccaacggccacugaaacaaccaaaaaucggauucugcaccuuacuaccgccagaaaagaggcuacccaaggcacacccacucuuccaacgacggcgccuacuagaggaagucaacgcgcugagaauaguacuccccggcaaagaaacgcgagcccucgaaaaagcagagcgggacgcucugcucaguaaacuaaaccagcgaaagaaagcagcauacgaaagccucagaaaagcguuaaaacuagaucccgacgcaagguucaacaaggaaagcgacaacagagaagacaugauaggggacgaaaucgcggcagagauggcccacaaaagccgauucggcaaagucuggcuaggaaugucagcagaagcccaagcccaagucauagaaagacuacggggucuggaauccgacgcagacgcggacgacuuugaggcauggcuaagagacgaccacgggcuagcccaagaacaggcaaaagcagucacagcggcuaacuuacccgaaggauacgggcgauucggggagacugcaacgagaaagcuaauugcagcacuagagcaagaaguaauaguguacucagaggcaguacaacgcgccggcuuaggucaccacagcgaccuccgagacggacaaguguggacagacaagaagggaaauccagcacuaccauauuacggcgcaguacuagaacgccacauaguaccaggcacagcagacccaaacgaaaccgacgacgcacuaagaauaggacgccuaacuaauccaacuguacacauaggucuaaaccagcuccgaagagucgucaaugcccuaaugcgacgcuacggccaaccgcaagaaauugcaauagaacuggcacgagaacucaaacucucggacgacagaaagaaagaaauaaauacuagaaacagggagaaccgaaaagcagccgaaaaacgaucccagaagcucagaaacauaggacaagccgacaagggaggaaaccgcgcacuguuaaaacuaugggaagaauuaaacccagaaaauguccuagacagaagaugcgucuacacaggcagaguaaucucaauagacauguuguucucaggggcagcagagguggaccacauccuaccauucagcgucucccuugacgacucgaacggaaaccgaauacuaugucugcgagaggucaacagaauuaaacgacaacgaacaccaugggaagccagagaugaccuccgagcacauuuuggcccagacgcggggugggaagcaauagcagcacgugcagcgaggcugcccagggaaaaacgguggagguucgaaccagacgcagcaaacagauucgacgcccagggaggcuuccuagcgagacaucuuaccgacacacaacaccuaaguaggcuagcucgcuccuaccugagcgcacucuaccccgaaacgggagaggggagugggcacguaugggugagcccgggccgacucacagagaugcuaagaagggccuggucgcucaaccaccaucuaccagaccacaacauugccggcgcggcaaaucaacccaagaacagaaaagaccacaggcaccacgcaauagaugcaauaguagucgcccuagcagauagggcaaugcucaacagaaucgcacgagaauccggcaaggaaggccaugaggcagcaggcaggcucguagccaguauacccgaaccaugggaaggauucucagacgaaguaggcagagcaguaagagcaauaacaguaucacaccgaccagaucauggaaccgcaagcaaagccggacgagcgaaagacaaggacgcaacagcaggacgcuuacacaacgaaaccgccuacgguuugacuggagaaaaagacgcacgcggccucgacauuguggugacgcgaaagccacuguccgcguucaagaaauccgccgaccuagacgccauaagagacgacgaccuaaaacaaaaacucaaagccugggcagcaggcaaggaaggaggggcauucgaacaggcgaugcggucauucggagacccagaacggggacccagaagucauccaggacuucgccggauacgagugacggaaccccugagcguaauaccgaucagagauagggaugggcgaccauacaaagccuacaaaggggacagcaauuaccgauucgacaucugggaacuaaaaacgggcaaauggaaggacgaggucgucucaauguucgaagcacaccgaccaaacuggaccagcccgaucagagccggcaaucccacagcacgaaaaguccuaagcgugcgccaaaacgauguaaucgcgauagaaagggaaaacggcccagaacugaugcgaguagugaaauucagcgcaggcagucuggcucuagcuccaccacaagaggcaggaagccucaaagcacgagacgcagacaaaaacgacccauucaaauacguauauggcagccccaguucacugcaacgguggaaagccagacagguaagaauagaugaacuaggacgaguauucgacccgggcuucgcaguaaggucacgaaggagcuccgaguga

SEQ ID NO: 7386 - RNA, 3291 nt, Artificial Sequence
  Cas9 variant
augaaaaacauauucagcuuugauauagggaccaacagcauaggaugggccguccuggcacuagacggaaacggcgaccccgugcgaaucgccgacgccgggguccgaauauucuccgacggcagggacccaaaaucaaaagccucguuagcagaagcccggcguauggcaagggcaaugagccgccgacgagauagaacacuacggcgcaaacgcgccaccuuacggacacuggcagaaaucgggcuaaugccagacacgagcuccgcgcggcaggcacaacuccgugaaacauccgaccccaaguccggcagcggacaacugacccgaaacccauacgcacuccgagcacuggcccuagaggaaaaacuaccacuguuccacaucggacgggcccucuaccaccucggacagcgaaggggauuccaaagcaacagaaagacggacagaaaggacaacgacaaggggaaaaucgcucugggaauugaagaacuccacgcggccaugcgacaggacggcgcacagaccuaugggcaauggcuagcccgcagacacgcucuagggcaagcaguacgacuaagaagcggagcgcuagaccuagaaggagaaggcuacgcauucuauccagaacgcaaacuccucgaagacgaguuccaccgaauaugggaggcacaagcgaggcacuaccccgauaucuuaacacccgagcgacgagaccaccuguuuacggucauguucuuccaaaggccgcucaagaagcccaaaguaggcaagugcagcuucaauaaucaagaagaaagacucaguaaagcacacccacucuuccaagaguucagacucuacaaagaaguuaacgaacuagaaauaguagaacccgaccucacgcacaagaaacuuacacuggaucaacgcaacgcucuagucaagaaacuccaaguaucacgcgaagcauccuucgcagcccuaagaaaaguacuaaaacuacgaccagaucagagacugaacaaagaaagcgagucgcgcaccaaacucaaaggcaacgaggucuacgcaguucugagcgacaaaacaagauucgggccccgcuggggaaccuucagccaagcugaacaaugggcaauuauagagagacuuaaagaagaggaggacccaggacgauuguucgcauggcuuagaagcgcauucgggaucgaaggcgaacaggcagcggacaucgcaaacguacaucugcccgagggacacggacgccucggcaaaacggcccuagaggcaaugcucgaggaacugaaagcagaaguaaucaccgaagcagaagcggccaaaagaugcggcuacgaccacgcacgccucgggggcggaagcgacgaaggagaacccgaauuaccacccuaccaggagauauugcaacaccgcauacccccaggcacgaacaaccccgacgacccuuacgacaucgaaaaaggcagauucacgaaccccacaguacacaucgcacugaaccaacugcgacacguaaugaacacgcugauccgacgguauggaaaaccggcccaaaucgccguugaacuagcccgagacuugaaacugucggagcgacaaaaagaagaggugaacagaaccauagcaagaaauacccgcgacgcagaacgcagaggcaaaacacuggaagaaaacaggauaccaaacacaggauacaacaggacacugcuucgccugugggaggaacuaaaccccggcaaaguagaggaccgaugcugcauauauacaggaaaaccaaucucaauaagcauguuauucucgggggaagucgacaucgaccacauccugcccuggagccgcacgcuugacgacagccacgggaacaagcugcuaugccuacgugaagcaaaucgggucaaaagaaaccgagccccugcagacguaacagaauggagagacaauuacgacgaaauacucagcagagccgcgagacuaccacaaaacaaacgcgaccgguucgcaccggacgccauggagagguucgaaaaagccggaggauuccuagcacgccaacucaccgacacccaauaccucagccgaauggcccucgaauaccuugcgugccucuuucccgccgaagaaauggauggcuucggagaacuaaggagacaccgguacauaaauguaugcccaggccgacucaccgagaugcucagacgcaacuggggucuaaacagcauauuauccgacucacaacugggcgaaaccgcccaagagaaaaaccgcaaggaccaccgccaccacgccaucgaugcaaucguaaucggagucaccggacgaucgcuacucaacagaaucaguuacgcagcaggaagauuagaagcccaacaacuggaaacgcuagucaaagaagcagccgccacaaacaaaccgugggacggauucagagaagacguagcaaaagugguaggcgggaucaucgugagccacaaacccgaucacgggacggcuggacgcaaagcaaaagacccagccagacaacaaaccgcaggccgacugcacaacgacaccgcauacgggcucacuggggaaaccgacgcccgagggaacacgaucguuguccgacggaaacccuuccuaagccucaccucuaaagacauacccagcauaagagacgaagcacuaagagcaguacuggaacaacacuuacggggaauacccgacggcaaggcuuuccaggcagcgcucgaugcauuccgaaaacaaaagggcuuucaccacuaccauggaauccgacacguccgacuaacugagccucuaucagucauuggaauuaaggaccgggacgguaaaguauacaaaggcuacaaaggcgacgccaaccagagguaugacguaugggaaacacuggacgggaaauggcacgcagagguagucagcauguucgaugcacaccaaccaggcuggcaaucacgauuccacgccgagaacccaacagcccguagagugcugcgacuccaacaagacgacaugguagcgcuaaaugccccagacggcggccggcuacuuguacgagugguaaaauuccgccaaaacggacaaaucacauucgcgggacacaacgaauccggaaaccuaaaagcccgcgacgcugccuccaacgaacaagaccccuucaaauacaucucgcgcauggcaucuagccuaaaagacugcggaugccggcaaguccgcauugacgcaaccggccagguauucgacccagguccccaggaccgggcaagccggcuacaaaaacaaaguaaacguuga

SEQ ID NO: 7387 - RNA, 3294 nt, Artificial Sequence
  Cas9 variant
augaagaagcaaccacagcgcuacaucuuaggacuugaccuaggaaucgcaucagugggaugggcucuaauucuaguagacggagcagagaaccccguagguuugcuagauugcgguguaagaacuuuugaaagagcugaaguaccaaaaacaggcgacucacuugcucuagcccggagacaagcgcgauccgucagaagacucauaagacgccgcgcccaccgacuacuccgacuucgaagacugcuaaaaagagagggaauccuaucagcggcugacuuuaacucugacggccucccgaaccuccccauagacgcauggcagcuacgcgucgccggcuuagaacggaaacucacaaaucaagaaugggcagcgguacugcuccaccucguaaagcaccgaggauacuuaucacaaagaaaaucggaaacccagaccgaaaacaaagaacucggacgccuacuugccggagucgcagaaaacuccaaacugcucuccgaaagcagcgagcaguaccgcaccccugccgaacuagccguuaaacuuuucgcagaacaauccgggcaccuacgaaacaagggcggugaauacacccacaccuucaacagacuggaccuacaaaaagagcuacaccuacucuucgaacgucaauacgcgcuagguaaccccuuugccagcgccgagcuacaaagcaaaguggacgagcuccuaaugacccaacgauccgcccuccaaggcgaggcaguccugaaaaugcucggaaagugcacauucgaacccuccgaauacaaggcagcuaaaaauacauacagcgcagaacguuucaucuggcugaccaaacucaacaaccuccgcauccuguacaacggcgaagaacgggcccucgacgaaggugaucgcaaaaagcugcuggacgagccguacaagaaagcaaaacucacguacaaacaaguccggucaauacuaaaucuucccgagagcgccgucuucaaaggccuacguuacggcaaagacuccgacggccucaaagccgaaaacggcacgcuaauggagaugaaagccuaccacaagauuagaacaauccuagauaaagccggacugaagggggaaugggaaaaccgaaucagaaacccagaaauccucgacaagauaggaaccgcauucucacucuacaagacagacgaagacauccaggccgcccucgcagaccuacgccucccagagaacguccuggaugcccuacuagccggacucaacuucgacaaauucauacagcuuucucucaaagcccugcggaauauacucccccucauggagcggggcauaagguaugacgaagccugcaaggaagucuacggugaccaccgagcccuagcagaguccaaaaaccaaguacuucucccaccaaucccagcagacgaaauccguaacccggugguccugcgaacccuaacgcaagcccgcaaaguaaucaacgccauaauacgucgguacgggucaccccaacggguacacauagaaaccgcgcgcgagcuagggaaauccaaacaagaacgcgauaaaaucgaccggaaaaacaaggaaaaccagaacgaucgaaauagacuagcaucagacauccgaaagcacuucaacuucgaaccaaccccgaaagacauacugaagcuacgacuuuacgaacaacaacacggaaaaugccucuacucugaccuacgagaagaaaaaggagaaugccuauauaccggcaacgugaucgaacuacaccgccuguucgaagacggcuacguagaaaucgaccacgcccuaccgcugagcagaaccugggacaacucacucaacaacaaaguccugguccugaaauccuccaaccaaaauaaagggaacaaaaccccauacgaauggcuagacggcgcgaacaacucccgacgauggagggaguuccaagcccgcguccaaggcugccacuuccccuacgucaagaaacagcgaauccagacagcaaaacuggacagcaaagccgaacaaggauuccucgaacgcaaccuaaacgacacucgauacauaagcaaauucaugugccaauucauaacggccaaccucagacucgcagaaaccagcaacgcacucauggaagaaguagcgggugaaaaccccuacuggaaagaacguaaacgccaacgcguauucgcacccuccgguuccauaaucgcccuccucagaggcuuguggggacugaagaaaguaagagaagauaacgaccggcaccacgcacuagacgccaucguugucgccugcuccacgguguccaugcaacagaaaauuacaaaagccaugcaacgacgagaaacccucgaaaccgucgacucagagaccggggaggucaaaacccggauaccccaaccaugggacuucuuccgccaggaagucaugauccgcguuuucuccgacaguccccgagaggaacucgccgaaaaacucaacucccgccccgaagcacuucacgacuucguaucaccccuauucguaucccgagcacccaaccgaaaaaugaccggacaaggccaucucgaaacagucaaaagcgcaaaacgucuauccgagaacauaagcgucguacgaaaaccauugaccgcacugaaacuaaaagacauagagaacaucgucggcuaccccgaccgagagcccgcacucuaccaggcccuaagagaacgccuucucgcccacaaagacgauccagugaaagccuucgcagacaaaccuuucuacaagcccgcuaaggacgggggacagggaucacucgugaaagccguccgaaucaucgaaaacacgaagcacggauuaaaaauccguaacggcaucaccgacacuaacggagacauggucagaacggacgucuaccagaaaacagacaagaaaggaaaaaggcaauacuucaucguacccgucuacgcauggcaaguagaaaagaacgagcugccaacgguggacugcaaaggcuacgagaucgacgacaacuacgaguucugcuuuucacuuuauaaauacgaccucauagaaauccaaaaccccaaugacauuaaccaagaauuacgggcuuacuacaucaacugcgacucguccgacggccgcuucugguuagcuuaccacgacaaauccgcuaaagaacaacaguucaggaucuccacacagaaucagccgaucaucaaaaaguaccaagucgacacacucggaaaagaaauaaggcuuugcaaagcagaaaagcgcacggcccuaaacggcaagaagaaaaaguga

SEQ ID NO: 7388 - RNA, 3294 nt, Artificial Sequence
  Cas9 variant
augggcaagggagauauacuguucagcuuugacauagggaccaacagcauaggguggugcgucuucgcacucagcgacaacggagacccaugccgcauacucgacgcaaaugcacgaauauucgcugacggacgagagccuaaaaguggaaacucgcuagcugaaggcagacgagccgcucgagccauggcacggcgccgcgaccgcuacaaaaggcgaagaaaagccguccuaagaacccucacagaauacgggcuaaugccggccgacccuaaggcaagacaggcccucguagccaagaccggggaccggggcccaaaaagugaagaagcacuagcggacguguacucccuacgagcccgagcauuaauggagaagcuaccauuacaccacauaggcagagcauuguuccaccuaaaccagcgucggggauuuaagagcaaucgaaaaacggaccgaaaaucaaacgaaaaaggagcaauagaaacaggagucaaccgacuccucgaagaaaugagagacacgggagccccaaccuugggagcauaccuagccaagcgcagauccgaugggcgcccaguacgcguucgagccggcgcgucagaacaagaagccgaagacgggaaaccagccaaaacagcauacgacuucuaccccguacgacggcugcuagaagaagaguucgacgcgaucugggagaaacaauacucauaccacccagaaguccugacggaggaaaggagaggccaccuauuccgagucauguuccaccagagaccacuaaaacccgcaauaguagggcgauguagcuucaacagugcugagacacgccuggccaaagcacacccacucuuccaggaguucaggcuguacaaagaaguaaacgaacuagaaguuguaaugccagaucaaucacaccgcaaacucacacugccggagagagaccggcucguccuaaagcuccggggccagcgcaaggccacauacgcagcccuaagaaaagaacucagacugagagaccuccgcuucaauaaagagacggaaaacagaacagacaugaugggggacgaaguaaccgcagcacuagcagacaaagcagucuucggaaaucgcuggucaggauucagcaccgacgagaaguggagaaucgucgaacgacugcgggaagaagaagacccauucgccuuacacgaauggcugguaagcgagcacggccucagcgaugcagaagccgagcaagcagcaaaaguucaccuaccggacggcuacggccgacuugguccaacggccgucagcacaaugcuagaagaacuaaaagcagacguaauuaccgaagccgacgcugcccggcuagcgggcuacgaccacagccucgcccgcgcggacgaagacggacucgaucggcuacccaaauaucaagagguccucgagcgaagaaucccaccaggaacaaacgacccagaugaccccuacgauaucgcgaagggacgcaucaccaaccccacaguacacauagcccuuaaucaauuuaggcacguaguuaacgcgcuagcacguagauucggcaaaccggaucaaauagcaauagaacucgcaagggaacugaaacucaacgacagacaaaaggacgaaguaaaucgaguaaucggccgcaacacaagggccgcagccuuaagaucucagaaacuccgcgauaucggacaaaaagacaacggguacaauagggcgcuccugaaacuaugggaggagcuaaacccggacaaaccagaagaccgagugugcgucuacacagggcgaccgauaugcauaucaauguuauucucaggagaaguggauguagaucacauacuaccguggagccgcacaauggacgacucccaagcaaacaggauccugugcgucguagaagccaauagaguaaaagcgaaccgagcacccgccgaaguagccgaauggggcggacgcuacgacgaaauacuggaaagagcagccagacucccccggaacaaacgauggagauucgcgagagacgcgauggagaaauacaaagaaaacgaaggguuccucgccagacagcuaacagacacccaauaccuauccagauuagcaagagaauacgcagaagcacuguaucccaccgaagaaccagacagacuaggcgaacugcguagacgaaaccacguccggguaauaccaggacgccuaaccgaaaugcugcgcagaggauggggucuaaaugcacuacuacccgaccacaacuuuggggccgggcaagcuaaaaaccgaaaagaccacagacaccacgcaaucgaugccgccguaguaggcguaaccacacgcggucuacuacagcguauaaguacagaagcaggcuugcgugagaaacucgcacuggaagaaacaauugcagacauaccgaugccauggccaggauuuagagaagaacuaaaagccgcaauagaccgcgcggugguaagucacaaaccagaccacggcacccugccaaagccgggcgaacacggacgaacggcgggccaacuucacaacgacacggcuuacgggauaacgggagagaccgacgcccguggcaaccccaucgucguccgcaggaagccauuccuaucgcucaccgacaaagacauaccaagcauacgagacacagagcuacggggacgagucuauagcgcaaccagcggccuuagcgggcgugagcuaucagcagcccuagacuacuuucgcaaaaccgacaaacaauuccggggcaucagacacguccgagugacugagagcuugucggugauaccaauccgcgacagagacggaaauaucuacaaaggcuacaaaggagacgcaaacuuccgguacgacguaugggaauuaccagacgggaaauggaaggcggacgucguaaccauguucgaugcgcaccgccccgaccgagcagcagaagaaagaagaccccacccagccgcccggaagguccuaucacugaaacagaaugacauggucgcaugcgaacaccccaaagacggcuacacgaucggaagagucguaaaauucaacacagcuggacaaauauacuucgccgcacauaaugaaggaggcagccucaaggcucgagaugcggacagagccgaccccuucaaauacuuuucuaaaagugcgagugggcuaaaagagauagccgcaaggcaagucaggauagaugcaacaggacaaguccuggacccagggccucaagaccgagaauccagguuagccagaaauaagcgacuugagagagaaagagccuga

SEQ ID NO: 7389 - RNA, 3303 nt, Artificial Sequence
  Cas9 variant
augaaauacaccauaggccucgauaucgggacaagcuccguaggcuggggugucaucgacacugaaagaaaccgcauccaggaccucggggucaggcuauucgaaagcgcagaaaaucaaaaagacggcgaaucgcuagccaaacccagaagagacgcccggagcaugcggcgccgccuagcgcgccgcggaucaagacuagaacgaguuaaaagcaucuucgaaaaagcgaaguuccuaacgcgaggccagaugggcauuacccacgcacgccccaacgaucccuaccgcuuacgagcugaagggcuagaccgacuauugagcaacgaagaccuauuuaucgcaguauaucaccuggcaaagcgccgaggcuacaaauccaaccggaaaaacguacucgaaggagacggagaggacguaagagaggguaaggcuguacucgacggcgucgcccaaaacaagaaacuaauggccuuccgaggcuaccguacagugggugaaauguucuucaaagacagcguuuucaccgaagcaaagagaaacaaagccggguccuacaaacacugcguccuuagagagaugcuagaggacgaacucggcaagauacuccacgcccagcgcucccucggaaauacccuagugacagauagcuucauaucgaaacuccuagaaaagaaaaccgguguguucguauaccaacgcccguucgcaucaggcaaccaaauacuaaaacucguaggcccaugcacuuucgaacccgaggagaucagagccgcaaaagcaaccuacagcuuccaauacuucaauguccuccagagacucaacaaccugaccaucaaaaauacggacacaggaacagagcgaaaacucaccagugaggaacgggcaaaaaugaucgccuucauauucucucacaaagacgugcaauacgcccagauccgccucgaacucaaacucagcgaugucgaucguuucaacauggucaauuacuucgugcagcgaaaagaacuugaaacaaaaaccgccgaagaacugcgacgugagauagaaaagaaaaccaaauuccccagccucuccgacuacuacacaauacgaaaaaccguaagcgagauagacucugccuucuggauccaaauagaaaaacaacaugacguaauagacgcaaucggcgagauauucacacuuuacaagacagacgaagacauaaucgcucaguugaacaccagaauccccagcauaccaagaccaguugucuccgcacuucugggccugucauuuaccaaguuuggccaccucucgcuuaaagcccuacguaaaauaauaccgcaccucgaaaauggcgacacuuacgacgucgccugcgcaaaggccgaccccaaauacaccgaccgcgcgaaaacccgcgcccgcaaauugcgcccucuagacaaagaagaccacucgaucacaaacccuguugccagacgagccaucgcgcaaacaaucaaggucgucaacgcaaucaucgacaaauacgacagccccagcgaaguacacauagaacucggacgggauuuagcaaagaacuuuaaggaaagaaugaagauacagaaagagcaaaagcaaaaccaagagggcaacgaacgagccauugccaaaauccacgaacucuacaaacucgaaaauccaagaggccaagauaucauaaaauucagacuguggaacgaacagaauggccaauguauguacagcggagagcgaaucgacgagauacgccucuucgauaacggcuacaccgaaauagaccacaucauaccguucagccgauccuucaacgacagcuacuccaacaaaguccuaguccuaaaaaugcgaaaccaagaaaagaugaacaaaacgccauacgaauacaugggcggcgacgccgacaccuggcaacgguucgagaaccucguaaacagcaugcacaauaucggaccccgcaagaaacaaaaccuucugcucaagaaauacguggcagaugaucucacacuacgaacccucaacgacacaagauucaucgccagauacaugaaaaacuacauagaaaacacgcuacuguucacagagggcccacaaaaacaacggguauacaccgucaacggccaagcaacagcuuaccugcgaaaacgauggguccuccauaaagaccgaaccgagaauaaccgccaccacgcccaagaugcagucgucguugcagucgcuaccccaagccucgugcaaggcauaaugcgccacgcaaagaugggagaaauagucgauuaccuccacucacaaaaguucgcaccaaacguuacagacaucgaaacgggcaaaccauucgagagcgccgacauccaguccgccaaagagagaauaauagccaagcacgaacaccgauuacgcauaccagagccaugggaaggcuucagcgaugagcucgacgcgcgaaugggagaugacgucguagaaaaacuuucccuacgaaaauccaacauccacggauacaaaaccaccuccgauuucucccaaauacauccaaucuucgucucccguaugccgaagaggaaaacgacaggacgggcacaccaagaaacccucagaucuccccgccgauucaaggaguuccaagaauccguagugcgaacaccacuuucauccaucaaccugaagaaacucgaggaaaugagcggcaaaaacucagauaaacuccucuacgauauacuaagaaaacggcuacucgcccacggagacgacccaaagaaagcauucaccgaaccgguacacaaaccccgcaaagacggcacccagggaccacuggugcgcucaauaaaaaugguuuccgaaggucagcgcaguggcauacucgugaacaaugaacaagcgcugguagaccaagacagcaugaucaggaucgacaucuucagcaaaccaaacaagaaaggcaaagacgaauacuauaucaucccaguauacgcguaccacuucgcccaaaaagaacugcccaacaaagucauaacagccaaagccgaagccgacuggcgcaccauagaugacaccuucgcguucgaguucucauuauaccccaacgaccugguaaaacuaacuaaaggcgacgacauacgcuucgguuacuacuccggcugcaaccgagcccucgcagccauccauauacuaccacacgaccaaaacaugccgcucgucaacaacggcaucaaaacccuggacaagauagacaaauacgucgucgacauccuaggcgaauaccacaaaguggguaaagaaaccagacaacagauccaguga
